United States Patent
Shinozuka et al.

(10) Patent No.: US 10,306,858 B2
(45) Date of Patent: Jun. 4, 2019

(54) MANIPULATION OF SELF-INCOMPATIBILITY IN PLANTS

(71) Applicants: Agriculture Victoria Services Pty Ltd, Attwood, VIC (AU); Dairy Futures Limited, Bundoora, VIC (AU); Dairy Australia Limited, Southbank, VIC (AU)

(72) Inventors: Hiroshi Shinozuka, Kingsbury (AU); Noel Cogan, Macleod (AU); John White Forster, Diamond Creek (AU); German Carlos Spangenberg, Bundoora (AU); Nicola Patron, Norwich (GB); Yidong Ran, Bundooa (AU); Luke Pembleton, Diamond Creek (AU)

(73) Assignees: Agriculture Victoria Services Pty Ltd, Attwood (AU); Dairy Australia Limited, Southbank (AU)

(*) Notice: Subject to any disclaimer, the term of this patent is extended or adjusted under 35 U.S.C. 154(b) by 74 days.

(21) Appl. No.: 14/769,423

(22) PCT Filed: Feb. 19, 2014

(86) PCT No.: PCT/AU2014/000146
§ 371 (c)(1),
(2) Date: Aug. 20, 2015

(87) PCT Pub. No.: WO2014/127414
PCT Pub. Date: Aug. 28, 2014

(65) Prior Publication Data
US 2016/0186205 A1 Jun. 30, 2016

(30) Foreign Application Priority Data

| Feb. 22, 2013 | (AU) | 2013900597 |
| Feb. 22, 2013 | (AU) | 2013900601 |
| Feb. 22, 2013 | (AU) | 2013900602 |
| Feb. 22, 2013 | (AU) | 2013900603 |
| Feb. 22, 2013 | (AU) | 2013900604 |
| Feb. 22, 2013 | (AU) | 2013900606 |
| Feb. 22, 2013 | (AU) | 2013900608 |

(51) Int. Cl.
| A01H 1/02 | (2006.01) |
| A01H 5/12 | (2018.01) |
| C12Q 1/68 | (2018.01) |
| A01H 6/46 | (2018.01) |
| A01H 1/00 | (2006.01) |
| C07K 14/415 | (2006.01) |
| C12Q 1/6895 | (2018.01) |
| C12N 15/82 | (2006.01) |

(52) U.S. Cl.
CPC ............ *A01H 6/463* (2018.05); *A01H 1/00* (2013.01); *A01H 1/02* (2013.01); *C07K 14/415* (2013.01); *C12N 15/827* (2013.01); *C12N 15/8218* (2013.01); *C12N 15/8287* (2013.01); *C12Q 1/6895* (2013.01); *C12Q 2600/13* (2013.01); *C12Q 2600/156* (2013.01)

(58) Field of Classification Search
None
See application file for complete search history.

(56) References Cited

U.S. PATENT DOCUMENTS

| 7,214,786 | B2 | 5/2007 | Kovalic et al. |
| 2003/0204318 | A1 | 10/2003 | Feldmann |
| 2007/0044171 | A1 | 2/2007 | Kovalic et al. |

FOREIGN PATENT DOCUMENTS

| EP | 1466973 A1 | 10/2004 |
| WO | 2011/135527 A2 | 11/2011 |
| WO | 2012/085862 A2 | 6/2012 |
| WO | 2012/150598 A2 | 11/2012 |

OTHER PUBLICATIONS

Miyao et al. Plant Molecular Biology 63: 625-635 (2007).*
Wang et al. DNA Sequence 19(3): 206-216 (2008).*
Hai, H. The Wordwide Vegetables, Subfamily Pooideae, last updated Mar. 2015, pp. 1-15, uploaded Aug. 20, 2018 from theworldwidevegetables.weebly.com/subfamily-pooideae.*
Shinozuka et al. (2010) Plant Molecular Biology, vol. 72, pp. 343-355 and Supplemental Tables 1 and 2a.*
Supplementary European Search Report dated Aug. 23, 2016 from related European Patent Application No. 14754321.9.
Thorogood, D. et al., Identification and mode of action of self-compatibility loci in *Lolium perenne* L., Heredity, 2005, pp. 356-363, vol. 94, No. 3.
Thorogood, D. et al., Self-incompatibility in ryegrass 12. Genotyping and mapping the S and Z loci of *Lolium perenne* L., Heredity, 2002, pp. 385-390, vol. 88, No. 5.
Yang, B. et al., Identification of genes expressed during the self-incompatibility response in perennial ryegrass (*Lolium perenne* L.), Plant Mol Biol, 2009, pp. 709-723, vol. 70, No. 6.
Examination Report dated Mar. 24, 2017 from corresponding New Zealand Patent Application No. 630693.
Bai, Y. et al. "Genetic Transformation of Elite Turf-Type Cultivars of Tall Fescue", International Turfgrass Society Research Journal, 2001, pp. 129-136, vol. 9.
Baumann, U. et al. "Self-incompatibility in the Grasses" Annal of Botany, 2000, pp. 203-209, vol. 85.

(Continued)

*Primary Examiner* — David T Fox
(74) *Attorney, Agent, or Firm* — Larson & Anderson, LLC

(57) ABSTRACT

The present invention relates to methods for controlling hybridization in plants and producing hybrid plants. The present invention also relates to nucleic acids encoding amino acid sequences for self-incompatibility (SI) proteins in plants, and the use thereof for the manipulation of SI, including seed production, in plants, particularly of the Poaceae family. The present invention also relates to kits, compositions, constructs and vectors including such nucleic acids, and related polypeptides, regulatory elements and methods. The present invention also relates to expression of self-gamete recognition genes in plants and to related nucleic acids, constructs, molecular markers and methods.

Figure 1:
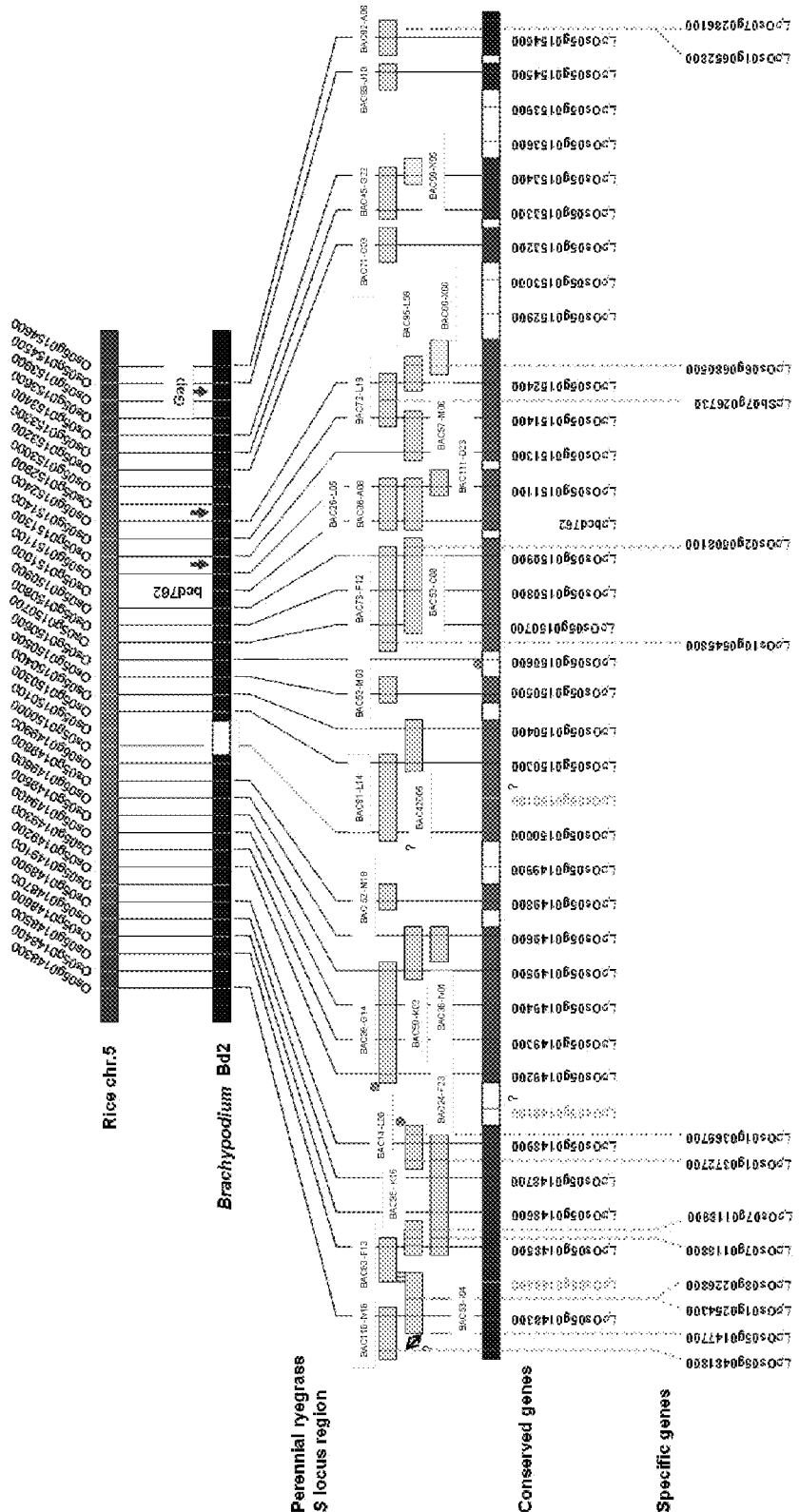

3 Claims, 144 Drawing Sheets
Specification includes a Sequence Listing.

(56) References Cited

OTHER PUBLICATIONS

Bevan, M. "Binary Agrobacterium vectors for plant transformation" Nucleic Acids Research, 1984, pp. 8711-8721, vol. 12, No. 22.
Bilang, R. et al. "The 3'-terminal region of the hygromycin-B-resistance gene is important for its activity in *Escherichia coli* and *Nicotiana tabacum*" Gene, 1991, pp. 247-250, vol. 100.
Chenault, K.et al. "Cauliflower Mosaic Virus Isolate CMV-1" Plant Physiol, 1993, pp. 1395-1396, vol. 101.
Christensen, A. et al. "Maize polyubiquitin genes: structure, thermal perturbation of expression and transcript splicing, and promoter activity following transfer to protoplasts by electroporation" Plant Molecular Biology, 1992, pp. 675-689, vol. 18.
Cogan, N. et al. "Whole Genome Sequencing of Perennial Ryegrass (*Lolium perenne* L.) Supports Exome Assembly for Gene and SNP Catalogue Development" Molecular Breeding of Forage and Turf, 2012, p. 87.
Cogan, N. et al. "Development of a Transcriptome Atlas for Perennial Ryegrass (*Lolium perenne* L.)" Molecular Breeding of Forage and Turf, 2012, p. 86.
Den Herder, G. et al. "Seven in Absentia Proteins Affect Plant Growth and Nodulation in Medicago truncatula 1[W] [OA]", Plant Physiology, Sep. 2008, pp. 369-382, vol. 148.
Doerks, T. et al. "GRAM, a novel domain in glucosyltransferases, myotubularins and other putative membrane-associated proteins" Trends Biochem. Sci., Oct. 2000, pp. 483-485.
Douchkov, D. et al. "A High-Throughput Gene-Silencing System for the Functional Assessment of Defense-Related Genes in Barley Epidermal Cells" The American Phytopathological Society, 2005, pp. 755-761, vol. 18, No. 8.
Forster, J.W. et al. "Functionally Associated Molecular Genetic Markers for Temperate Pasture Plant Improvement" Plant Genotyping II, 2008, pp. 154-186.
Forster, J.W. et al. "Next-Generation Solution for Genomics-Assisted Breeding of Outbreeding Forage Plant Species" Molecular Breeding of Forage and Turf, 2012, pp. 49-54.
Fraley, R. et al. "Expression of bacterial genes in plant cells" PNAS, 1983, pp. 4803-4807, vol. 80.
GenBank Accession: AK330766.1 "Triticum aestivum cDNA, clone: SET5_E01, cultivar: Chinese Spring", Jun. 25, 2009.
GenBank Accession: DT687279.1 "s13dFA29A01FM005_476430 Tall fescue, Festuca arundinacea Schreb, Floral meristem Festuca arundinacea cDNA, mRNA sequence", Sep. 12, 2005.
GenBank Accession: DV854332.1 "col1592 Colonial bentgrass EST Agrostis capillaris cDNA clone COL356T_F02 3-, mRNA sequence", Nov. 29, 2005.
GenBank Accession: GR357268 "CCOY1790.g1 CCOY Avena barbata root, pooled from different levels of rain and nitrogen (L) Avena barbata cDNA clone CCOY1790 3-, mRNA sequence", Jun. 19, 2009.
GenBank Accession: GR521673.1"ELPLPE1017C10-g1RSP_20001129 Perennial ryegrass etiolated seedling library (LPE) Lolium perenne cDNA 5-, mRNA sequence", Jul. 7, 2010.
GenBank Accession: GR522370.1 "ELPLPE1038A08-g1RSP_20011026 Perennial ryegrass etiolated seedlings library (LPE) Lolium perenne cDNA 5-, mRNA sequence", Jul. 7, 2010.
GenBank Accession: XM_003568881 "Predicted: Brachypodium distachyon serine/threonine-protein phosphatase 2A regulatory subunit B" subunit gamma-like (LOC100824191), mRNA, Nov. 15, 2011.
GenBank Accession: DV858816.1 "col6076 Colonial bentgrass EST Agrostis capillaris cDNA clone COL430T_G05 3-, mRNA sequence", Nov. 29, 2005.
Hackauf, B. et al. "Approaching the self-incompatibility locus Z in rye (*Secale cereale* L.) via comparative genetics" Theor. Appl. Genet., 2005, pp. 832-845, vol. 110.
Hayman, D.L. et al. "Mutations affecting self-incompatibility in Phalaris coerulescens Desf. (Poaceae)" Heredity, 1992, pp. 495-503, vol. 68.
Jiang, S. et al. "The *Oryza sativa* no pollen (Osnop) gene plays a role in male gametophyte development and most likely encodes a C2-GRAM domain-containing protein", Plant Molecular Biology, 2005, pp. 835-853, vol. 57.
Kaster, K. et al. "Analysis of a bacterial hygromycin B resistance gene by transcriptional and translational fusion and by DNA sequencing" Nucleic Acids Research, 1983, pp. 6895-6911, vol. 11, No. 19.
Klaas, M.et al. "Progress towards elucidating the mechanisms of self-incompatibility in the grasses: further insights from studies in Lolium" Annals of Botany, 2011, pp. 677-685, vol. 108.
Li, X. et al. "Cloning a Putative Self-Incompatibility Gene from the Pollen of the Grass Phalaris coerulescens" The Plant Cell, 1994, pp. 1923-1932, vol. 6.
McElroy, D. et al. "Isolation of an Efficient Actin Promoter for Use in Rice Transformation", The Plant Cell, 1990, pp. 163-171, vol. 2.
Rogers, S.G. et al. "Investigation of Factors Involved in Foreign Protein Expression in Transformed Plants" Biotechnology in Plant Science, 1985, pp. 219-226.
Shinozuka, H. et al. "Fine-scale comparative genetic and physical mapping supports map-based cloning strategies for the self-incompatibility loci of perennial ryegrass (*Lolium perenne* L.)" Plant Mol. Biol., 2010, pp. 343-355, vol. 72.
Spangenberg, G. et al. "Transgenic Tall Fescue (*Festuca arundinacea*) and Red Fescue (*F. rubra*) Plants from Microprojectile Bombardment of Embryogenic Suspension Cells", J. Plant. Physiol, 1995, pp. 693-701, vol. 145.
Spangenberg, G. et al. "Transgenic perennial ryegrass (*Lolium perenne*) plants from microprojectile bombardment of embryogenic suspension cells" Plant Science, 1995, pp. 209-217, vol. 108.
Spangenberg, G. et al. "Future directions in the molecular breeding of forage and turf" Molecular Breeding for the Genetic Improvement of Forage Crops and Turf, 2005, pp. 83-97.
Thorogood, D. et al. "Self-compatibility in *Lolium temulentum* L: its genetic control and transfer into L. *perenne* L. and L. *multiflorum* Lam" Heredity, 1992, pp. 71-78, vol. 68.
Toki, S. et al. "Expression of a Maize Ubiquitin Gene Promoter-bar Chimeric Gene in Transgenic Rice Plants", Plant Physiol, 1992, pp. 1503-1507, vol. 100.
Voylokov, A.V. et al. "Mapping of three self-fertility mutations in rye (*Secale cereale* L.) using RFLP, isozyme and morphological markers", Ther. Appl. Genet., 1997, pp. 147-153, vol. 97.
Ye, X. et al. "Transgenic Italian ryegrass (*Lolium multiflorum*) plants from microprojectile bombardment of embryogenic suspension cells" Plant Cell Reports, 1997, pp. 379-384, vol. 16.
Office Action dated Feb. 5, 2018 from related Japanese Patent Application No. 2015-558304.
Hua et. al., The Cullin-Ring Ubiquitin-Protein Ligases, Annu. Rev. Plant Biol., 2011, pp. 299-334, vol. 62.
Kakeda, K., S locus-linked F-box genes expressed in anthers of Hordeum bulbosum, Plant Cell Rep., 2009, pp. 1453-1460, vol. 28.

* cited by examiner

```
cggcgcggcc cctggaagct tcgtggcaaa ataggaccct gggcgttgat ttcgtccaat      60
tccgagaata tttcgttact aggatttgtg aaaccaaaaa caacagaaaa cagcaactgg     120
cacttcagca tcttgttaat aggttagttc cagaaaatgc acgaatatga cataaagtgt     180
gcataaaaca tgtagataac atcaataatg tggcatggaa cataagaaat tatcgatacg     240
tcggagacgt atcagtgaac cattgcttag cataagttgt tggtgcacat aggtgaacca     300
tagtatatag gctttgggct tgacaaagta aacgctagtt ttattccgca tttgttaagc     360
ccatctcgta aaagttttaa atcgcctatt caccccctct aggcgacatc cgtgtccttt     420
cagtttctac tagcaacgga gagcatacaa gatcacaaat aacatatgac atgaatatat     480
aatcaatctc aacatagtat tcaatattca ccggatccca acaaaccaaa catagatgat     540
tacataaaga tgatctigat catgtagcgt agctcacaag atcgatacat gaagcacaaa     600
gtggagaaga caaccatcta gctactgcta tggacccata gtccagggat gaactactca     660
cgcatcactt cggaggcggg catggcgatg tagatgcctc cgacgataat ttccccctcc     720
ggcaggqtgc cgggaagacc tttagcaccc cccagatgcg gttctgcgat tgaggccgcg     780
acagaacttt tcgtggatgg agactcggg  atccaggatt ttccgagaa gatgtataaa     840
taggcggagg cttgatgttg gttgggcgcc tggtgggccc agacctaccc taggcgcggg     900
ccaggtccaa gtcacgccta ggggtggtct ggccgacctg ctgcgcctct tcgtcccct      960
ctggacttcg tcttcgtttc ggtaaaatat tgacttcggc ttttgtttcg tccacttcgg    1020
ggaatatttc ctgtatatct tttctgaaat acaaaaacaa tagaaaacag ggactgtcac    1080
tatggcatct tgttaatacg ttagtgacga aaatcatgta aaagtgcaac gaagtgtaaa    1140
caaaacacat atgaattggt gtaaaacaag catggagcat caaaaattat agatacgttt    1200
gagacgtatt agttgtcatc ctgacttctc aagtagactg acccaacaag tcatacccgt    1260
tgggtcgaca aacttaatat ccgcgctgaa ctaggtccgt aaccatgcca tgctaggaca    1320
tgaccatacc ccatagaatc atcacactac aacgttctga tcttgttccc tctgcgactc    1380
ggcgtacatc cacctccggg atgttgtccc gactaccatc cctaaccaca aatctgcctt    1440
gcccaaccac cataaatttg ccacaccatg aggctaagaa ctccaatgtg gcacctcaaa    1500
gaaagtagcg acatgtgtgt cgctgctttg cgctctagcg aagcttaggt tttcacccaa    1560
aaatcacagg accactcgcg tgtgtagtga tcatagatct aatgatgcaa ataaaagaga    1620
ggatcaaaga cgccaccgtt attgacaccc cacccaccaa agtcacccgg agtgcaatcc    1680
aaccgccaac tcccgaggca acttgtactg caggagcagc aagcagagcc ggctctgctc    1740
cgcctatagt cccacaacat gaaggccacc tccattttaa actttattgt tagatttgtg    1800
tcatgtgatt tccactaaca caccattcaa atgttcctct cattttctct attacacgtt    1860
gaaaaataat tttatgtgat ttttactctt acacgttgaa aattcatttg tgtgattttc    1920
actattgcat ggtactcctt ccgtataaca aaggatgttt taagtttgtc taaatctata    1980
ttaaaattta gataaagttc agacatcttt tattggacgg agggagtaca aaagatttat    2040
cagggaactt catgccattt gggtaaaatt gaatttcgaa tttaaacata tgatatgaaa    2100
ggttttttttt ttgaacattg atatgaaagt gttgtttatt taattttggc acggcctcta   2160
tgttcgtttc tagaatacac gaacagaaat acgggtcgca ccggaccgga ccggaacccg    2220
gttctgccag acgaccataa taaaaccaca gcaccgcaca gggcgagatt tcaagtcctc    2280
tgctccgcct tcttgggaag gaagcaaagc cgatccgccg ccgccgagga agcg atgcc   2340
gaggccgacg atgccgcggc cgcccgccga cgcaccgtgg tcaccgacta ccgcaacaag    2400
ctcctgaact gccgcgagct ggagacgagg gtccgcacag gtaacacgac gcctcctccc    2460
ctctcatgtg ttctgggtgc ttgttcgatc tgtagggttc agactagttg actcgctccg    2520
agctatccgc gggtcctggc tagggttgct ggccactgga agataggatc tggttttccg    2580
tgattattag gatggcgca  ggctagggtt ttcggttttg accaattcga gttcgggagt    2640
tgcgcgcttg gccctgccgc gaggacgcct tggctgttct tctcggctag gctggtggtt    2700
ggttgctaat ttctcgctgg ggatgtgatt ttgggttggt agggtgttct gaacttgatg    2760
cgggcctcga tttaggagag cttcagtgga ttttacaaga tgggaacagg aggaatttgg    2820
gatgaagtgt taaaccatca gatcctcaaa ttagatgttg gcaaaaatta gtaaaaacat    2880
aacgatacca aacttttttt tttgtatcta cacaccttaa gctgtagtct gtagatgctc    2940
tgagcctcac cgaacaatgt tgcattgaaa ttagttgtat aagtaagccg cagctaggac    3000
```

FIG. 3

```
caagcatagc cagtagaaag attccaagaa catccatgga tggaacccaa acaaaggaaa    3060
gactactagc taggaccaag cattaccact agaaagagtc caagaacatc catggatgga    3120
acccaaacca aggaaagact actctataca agctcatgtt cataaccatg tcactagcaa    3180
ctcaatacaa ggagcgaagg agaaaataga aaaataaaca gacacataaa catagaactt    3240
ggatacatag accaccaaat ctgagatcgt tgacacctag tatctcgatc agctgagcaa    3300
ataattaata atcttggata caacacagaa ttagaacttg acagaggaaa gaagagtgac    3360
tacccagtat ctcgatcagg tgagcaaata attaataatc ttttgagcca ggttttaatt    3420
cctagttttg cctcggtcta gcgcctatat cgcctaagcg catgcctagg tgtacttaag    3480
cgagtggata gcacgattaa gcgctagctg ttttgctctc gcctagcacc tagacatgcc    3540
tttttaaacc atgcttttga gattgcaatt gcctcaacag atcatgaaaa actagccaaa    3600
tgttattatg atgtccaggt ttagcactcc cgacaaacta ctgacttcac attctaaaca    3660
aataacagtt caaactttac catctcttgg aagtaacctc acaaacaaat ggaccagaat    3720
aaccaccaaa cagaataggg caaacttctc aaagtatcgt taaatactca tcctgtccta    3780
atctactatt aaaagtgaaa catgtaatgg agtgattttc gtctctgacc gacagtaaaa    3840
agattgaaat gtgtagtgtt ctcctatagt tcctttgatc tgtgtgtaat tacctctaga    3900
atctgcattt aatccttgtc aagtggactg actgcgattg attacctgac cacctgtgcc    3960
tttgatatgc caattatgta ctgaatctgg cacatgcata ataacttgtt tcacttgtcc    4020
tgttgtccac atgtgcaatg gttcctgctg gatcgttttt tagataatga ttttgttgaa    4080
ctatggatga cattattcac agctcgttag atagctgttg tttgataagt ttacttattt    4140
atgtgcagct agggagaacc taaaaaacgc aagaaacgat tatgataaaa cagaagatga    4200
cttgaagtct ttgcagagtg tgggccaaat cattcgtcaa gtactcggc cattggacac    4260
tgaaagatgt aagtgaaaag gctttttttt ttggttttga aacaaaaatt tctctgtaca    4320
aacaatgata caagacatgc attctattct taacaatcaa tttcatcatc atattgcatg    4380
ttattctgtg tagcaacatg aaatgttttt actcatgcta ataaacctt ttcttctcaa    4440
attagcgact gaaacctgtt tttgctgaag ttatcgtcaa agccagcagt gggccacgtt    4500
atgtggttgg ctgcagaagc aaagtgtgaca aagaaaagct gacagctgga acgcgggttg    4560
ttcttgacat gacaactcta accactatgc gcactctacc acgcgaggta tatgggtatt    4620
ggcttttcat ctatggttta gttgattatc ttttcaagtt cagttgtag catgacgggt    4680
ttatttgcta actaaaaaac atgamcawmr trckmaytct gccacgtgag gttgatccdg    4740
tggtctataa catgctacat gaagaccctg gcaacgtcag ttacccagct gtaggtggat    4800
tatcggatca aataaggaa ctgcgggagt ctatcgactt accgcttatg aatcctgaac    4860
tcttctccg tgttgggatt aaaccgccaa agglaglttg aagaaaa ll gllcllllga     4920
gataacatac tatgctgtta gskmakmsak aagmatkcmm yyttmwsaat cywgarwtgt    4980
wtctwmrLry wgskatLamw cmLycaaagg gtgttctgct ctatggccca cctggaactg    5040
ggaagacatt gcttgctaga gctatygcta gcaacattga tgcaaacttt ttaaagaagg    5100
tttggttttt tctttaacgc tgttacatgt tagcaatctc ttatttggac atctttaata    5160
taatattttg aactattttg cattgctaat gcagattctt tcaagtgcta tcattgacaa    5220
atatattcgt gaaagtgccc gtcttataag agaaatgttc aactatgcac gcgagcatca    5280
agtatgtttg attatgcttt gtttctatgt atatcttctt atcctaaaca tttcatttt    5340
gttggaaaac tattaaaatc agaacaatgt aaacagtaaa ttgcattct tcgctcgtga    5400
ccaaatatat tttgcttcca agtttgtcca tgaactagct gcagaaagtc gattcattag    5460
gcgaacaaag caaagtaaaa aattagcgt ctgatacttt gcgagaaaaa tcaatggaaa    5520
catcttcact ttgaagttac tatgcatgtc tgaatggcac tctaagttct atrtctgttt    5580
cmmgtaaagc atatmattta gwcwastrtr tagtctgwam tgwgstcrtc tcattaatgw    5640
kwtattttct ttytmtgmwc stkwkswcya rccatgcatt atttcatgg atgaaatyga    5700
tgccattcgt ggccgaagat tcagtgacgg cactagtccw gaycgtgaaa tccaacggac    5760
attgatgcag ctcctaaatc agttagatgg atttcatcag cttgggaagg tacatgtttt    5820
ttcttttctg tgtgcacgtg tgttatgaca gcatgttatg gtaaaacata ttaacaacta    5880
tgaatagcta ttatacagtg ataatgatac gatgcttact tgtaactaga tgattttttg    5940
gttgatcaat tgtaatggtg aactagttag ttagttatgg aatcaatcta tcttgtctta    6000
```

FIG. 3 (cont)

```
tgagctactc cctacgtcct aaaatgagtg tcccaactct ttctagattt ggaggtattt    6060
ataactaaaa tacatcatga tacatccgaa tctagacaaa gttgagtcac ttatttatgg    6120
acggaggcag taccttcttg cctacaaggt aaggctattg tatggagcag tttattactc    6180
atcaggccag ttgtggaatg gcaacttctg tgtagaaact tcagaaatgt attaaaacaa    6240
gacattgaaa agttgaagat ggttgtcact gattgcttgt ctaatattat ggcgtgcaca    6300
tgtttggtga tgtacttaat gtctctcctt ttaatgtgaa ttatgcgtaa taagagtttt    6360
atgtgtaaca agagagctct tctgcctata aagctcaaga tgattatggc gachaaccgt    6420
cctgatgtct tggatcctgc actccttcgt cctcgacgct tggaccgaaa gatagaaatt    6480
ccattgccaa atgagcagtc gaggatggag gtcctgaaaa tccacgcagc tggtatcgcc    6540
aaacatgccg aaattgatta tgaggctgtb gttaagctcg ctgagrggct tcaatggtgc    6600
tgatctgccc aatgtctgca ctgaagctgg catcgctgaa gccttaacac ctatgcactg    6660
tcgttccacg gcttcaacgg tgccgatttg cgcaatgtct gcactgaagc tggcatggct    6720
gccattccag cagagcgtga ctacgtcatc catgaagact tcatgaaggc ggtgcgbaag    6780
ctgaatgatg ccaagaagct cgwrwcyary gcgcactaca gcgckgactt yggcaaggaa    6840
agccagtact caccatttta gttttctgat gatgatgaca aatgattgc aggcggtgcg     6900
aaagctgaat gatgccaaga agctcgagtc tagcgcccac tacagcgcag acttTggcaa    6960
ggaataacag atcaaagtag gacaccactca tctaaacttg agacgattca ctgagccttt    7020
acttctacca tggcggagtt tgtcatcctg gcaataccag agcgatcatg tacgtttctg    7080
cattgtatat gctttgggat gtctgccctt gcccgcacaag ttcgtctcgg cttcgttgaa    7140
aacagattcc atgtacacgc cggttcagtc tgaaactggc ctacttgagc cacagctatt    7200
cttagattta taacgtttgc ttctcctagt tgcttggaat caagaaatgt tggaaaaatg    7260
taacaattgc aacttgtgtt tctgtcttct gttactctac ctggaatcaa ggatgtcca     7320
agaaggaaca tttgcagcgt gtgctcctcc ctattactct accttggaat gtgcattgtt    7380
actttgccct gttgttaggg atatattcct tctgtgctga taatgacctg attcatgtgg    7440
aatttctgat tcatgtgaaa tttcgtant acaaacttac tcgtgctgaa cgaatattcg     7500
ggttgcttgc ccaaactttc cctctatggc tctatcggta gatctcgtta ctttgcaca    7560
ataaatttgt taggaaaatg ctatttttc agacggataa aaaggaaacg tggtcggagt    7620
cgtcgccgcc acgcgttggg tcgaaacgcc ctgtcctctc ccatcgctcc atctccgttg    7680
caccaatctc gaggctggag gcgcgctcaa aaccaaaatt agcgagcacc tggccggacg    7740
cggggaaacc gcccccatct ctcatctcga ttccgcacac aaggaaccaa accaaacatg    7800
gcaacccaac tttgatccat tccatctca atttctccgt gaattcttcg cgcaacaaca     7860
caggattcca agatcgatcg atcccaaatt ctgcattttt tccatatata cggttttcat    7920
cgcatgacaa agctcaagag cgtggcgtcc acgtggggg cggcggagga gtgcgcgcgg      7980
agcgctcccc agattgcccc gtcgccgatg aagctgctgg tgcgcgtcgt ggaggcgccg    8040
ggcctgctcg cggtgcacgt caacggcacc agcgaccct tcgtcaagct gcagctcggc     8100
aagcgccggg ccaagaccgc cgtcgtcaag aagaacctcg ccccgtctgt ggacgaggag    8160
ttcagcttcc tcgtcggcga cgtcaccgag gagctcgccg tatccgtgct caacgaggac    8220
aagtacttca gcaacgacca cctcggaagg gtcaaggtgc ccctctccca ggtcatgcac    8280
accgacgcc tctccctcgg caccgcatgg tacccagctcc agccaaagag cagcaagtcc     8340
aagaggaaat gccgcggtat ctttctatct aatctatcta cattatgttt tgggtttcct    8400
cttttgtcct tctgttgatt cggttactgg ttgaatctgt acaagcaaat catgatatca    8460
tgcacaacaa aaaagagca tattctggta atcttggaac catctaatta tctgccatct    8520
gcagggaaa tctgcttgcg catatcctig tctacacgaa cgcacgtgtc cgaagaactg     8580
caccctctac cgcgcccccac ttcggacggc gtatcatcca gttcagacag gtcaatcggg    8640
accaagcctg gagctctgtc aaccaccaac agctacattg acctctcagc cgtggccagc    8700
ttggaccag gatcgcagag cagctcgaa cggtcggcgg atagcttcgt ggagcagccg     8760
cccaggagca gcatcgaaca agcagtcacc gagcctgaa cggccgctga aactgatgcg    8820
atggccaaca cgtcgtcgat ggtagaggtc ttgtctgct atttctttcg gaaacctgtc    8880
gacgccgctg tggctgcagt tgtctctgat gccagtcgg tggtggatca gtcccccggag    8940
ccgaaagcgt gctctgaaga acgtgaaggt cctgagaatc gcacgccacc tgagtcgagc    9000
```

FIG. 3 (cont)

```
cttgatgagc tactgaaaat catggagtcc aaagatcaag gcgctgaaat gccagctaaa    9060
ctgtctaatg gcgttctgct tgacgaatct tatgttactg caccagccgg actgaatacg    9120
ctcttgtttt ctccaaattc agatttctgg ccggctgtag cagagcttca aggaacaagt    9180
ggatttcaga ttgaatcgtg gaagatcgat agcaacgatg gttgtttgcc aagaacatta    9240
agttacataa aagctgcgag taagctggtt aaagcttgca aggccacaga agagcagaaa    9300
tacttgaaag cagctgggaa ttcttttgct gttttgtcta ttgttagcac tcctgatgtt    9360
ccttgtggaa cttgtttcaa gatagagata ttgtactcta taacgccagg tccccagtta    9420
tcatctgaag agcaaacggc acaccttact gtaagttggc ggatcaactt tgttcagagc    9480
acaatgataa aaggaatgat tgaaaatggg gcaaaacaag gcatgtcaga aggttatgca    9540
caattttctg aagtactgtc ccaaaagttt aaagtagctg agcttgatga tgctaatgca    9600
agcaaagcaa agattttgcc ttcactgcat acacaaaaag aaccgagctg gaggctgatt    9660
gtccgcttcc ttgggaactt cacattcata gtctctgtta tcgtagggat atatattata    9720
gcacaccttc atttgtcaaa gcccaaagcg atgaatggct ttgagtatttt tggcattgac   9780
cttcccgatt caattggaca ggtcgtggtt tgtgctgtct tgatccttca gggacagaat    9840
atcatgaaag taatgaagcg cttttcgaat gcatggaaac aaagaggtac atatctcaag    9900
agccactatg ttatctactc tgaaacgggt tcacatgatt atgtatgctc tttattacat    9960
ttatgcttat gttgcacatg ctgtaagagt gaaagcgctg ttctaaaact agatgagctg   10020
aattgtcttc tactgcaacc aagggacatt ttgctctcta tatatgttct gatattgtat   10080
tgctacttgg tttcctttat aatatcagtt gcagttaaga attattggcc tttattttt    10140
cctttattag gtagtgatca tggagtcaaa gctcatggag atggttggat actgactgtt   10200
gcacttattg agggcagtcg tatagtagct ggtgattcct ctggcttatt tgatctttat   10260
gctgttttta cttgcaatcc gaagaggaaa acaagctcaa ttaaattcca cacctctcat   10320
ccaaaatgga atggttagtt tcactcccct tgatgttgtt ttgttcagttt gtcctcagct   10380
gtgaagagca ggcaatcttt tttgttatag tatcgcatta actgaccttc tcatatgcat   10440
agaatgtagc tgacccattt gatgcttgaa tttctagaga tattcgaatt tgatgcaatg   10500
gatgatccac catcaaggat ggatgtggct attcatgatt ctaatcgatc cgatggacat   10560
cccattggtc acgctgaagt gaactttctg acaagcagtt tgtcagattt aactgacata   10620
tgggttcctc ttgatgggaa gtgtgatcca gcaagcaacc ctaagctaca cttaagaatc   10680
tttttgaaca actcaagagg aactgaagtt gtcatgaatt acctgtcaaa gatgggaaa    10740
gaagtcggta agaaggtaag gacttcgaca acttttgtc caaacttttt tcatcatatc    10800
ttttattct gaaagtacat atgacacaat gtgtagataa attgcggtc agcacaaaca     10860
aattcagcat tccggaagct ttttaacctc cctccagaag agtttctcat tgatgatttc   10920
acctgccatc taaaacggaa gatgccactg cagctattac ttttctgatt gttttctttat   10980
gcgaaagatg ctattatttg agttgtcaaa gatttggtat gttgtctgac gtaatactta   11040
tatgagttca acatcagaag aaagaagaca tgtacatgca ttaccatact accatggaga   11100
atcaccgcga tagtttttgca ttcatttgac atttgccgct atttttgtatt ttctccattt  11160
tgtgctctct atagtaacaa agaaccgact cttttctttt tagggggcgtc tcttttttttc  11220
tccaagaata attggattct actctaatat atttggtcac aagacaaagt ttttctttttt   11280
gtgggaagac gtcgatgata tccaggttat ccctcctaca ctgtcaattg gcagcccatc    11340
cttgatggtc atcctgagaa aggatagagg gtcagaagca aaacatggtg ccaaggaaac    11400
cgataacaat ggaagattca agttccattt tcagtccttt gttcgttcg gtgatgctca    11460
caggtatctt tatccttcat ttgtatgctt ttgaggtcca gtgagacatc tggcccaaac    11520
ttatacagta ttatttttc agaacttaca gatccaaatt tcgaaacaaa agaaaataat    11580
taagatattg tttcctgaag ttcaatatat aacctgttca cctgtaatct ggcctgatgt   11640
gaatacactt tggttcgcag tcttgaagca cgaagctgtc ttggcctgat aatgaagatt   11700
ataaagaat aatattttct atagttaagt atagttttta ttatataaaa ggtatggttg    11760
taaacatagg aaattctgaa cattataggc ttttgggga tttgaaccta aggtgttgg     11820
gcttggctcg tgcagagcag ttaaattgaa tttgatggag atttttcttt atgaatatta   11880
aaacaagagt ttgcattacg ataggtataa gggtcttgac cacagacgtc aaatcccaat   11940
aagacaagga tttagatgct aggccccggg cggcccagca cttcatcttt ggttgtgcc   12000
```

FIG. 3 (cont)

```
accaaagcct gccatgctct gtctttattg ttgaagacat ctcttttaga attcccaaac    12060
tgccaagatg agcacttaaa ctggacgatt tttaggaacc gcgcaatact tcatattcag    12120
gttcttctat acatacacaa cctcatggta tataaataag caaacggagt aacaatacat    12180
ttatactttc tatcgattat aaatccgccg ttcgtattt cgaattcttg ccatgctact     12240
acctactaag ctattctgct ggtttggcaa tgaatttatt acactgataa acctttatct    12300
gacagaataa ttatgggat ttggaaaatg cggtcaccgg gtccagaaca gaaggggggag    12360
ataatggagg agtctgaact gaaagaactc ccggccgaag aatcagggtc cttatttagc    12420
catgaagatg tcaaaatgtc tgaaatattc tcatcagttc tctctgtgga cgtgagtgtc    12480
acttttacct tcacacgagc ttgtcactat ccgtttttcac actaaataat ctgttttggg   12540
attccctatg cacatctgta ttttcaggtt atttggaaaa tgcgatcacy gagtctcaga    12600
acagnagcgg gakatratyc aaaargagtc ygawmysaaa gaactccags ycgaagaaks    12660
tggawcctta tttacccatg aagatgtcaa aatgtctgaa atattctcrt crgyyctytc    12720
tgttgatcty gagtcctiga tggagatgtt ttcaggaggt cagttggaac acaaagtgat    12780
gcaaaagact ggttgtangg actactcgcc aacagaatgg gaacttgtaa acagaaatat    12840
ataccagcgg caaatcaaat caactacaag tttgacaaag cattgtctcg atctggagga    12900
gaagcaagca ccactcaaca gaagtatgcc ctagtgaacc aagatgggtg ggccattgaa    12960
gaggtgatga cactccaagg tgttctactt ggggactact ttagtgtaag aaacccttc    13020
cattcttcta tggtctggta catatttcaa ccattgctac aagtttgaca aavcattvtc   13080
aagatatcga ggagaagcaa bcaccactca ccagadgtat gctctagtga accaagadgg   13140
ctgggccatt gaagaggtga tgavcctvca aggtgttcta cttggggact gcttcadtbt   13200
dcagctccag ctgaagtatc atatggcgaa cgtaccgbca aaaccaaaca cctgcagtgt   13260
gcaggttttg ttggggaitc cctggttaaa cagcaccaag caacaaaaga aggtcacaaa   13320
aaatatcatg tcgaatacct ctaatagatt caaggagcta tttttctgaag tcgaaaagga   13380
tcttacgtca agaaacggta cccttttag cgcatctatt gatccttacc gttctttaca    13440
tgatcctaat atcacgtaaa gtcatagcag aactcgcatc aaattaatgc caggaaagca    13500
aatgtatatg atctttttca ttcctaccta tgaaatgaat tattaccact gagtggaaac    13560
taagaaaata aatctggtgt agtttcatat caacagtgac agaaaaagac tgaaacaact    13620
cccttcattt tgtctcaggc aagaatgaca ctgattttc tgtctgtgac aaatttctag    13680
gtgcaagcta acctgtgtac agcactaaca gtaggttgac cattccatca ttgcaattcg    13740
ttttaagagc ccagcagaga ggggaatagg caaagtgtac atctcttgcc gtctgcttgc    13800
ggtgcgacat gcttcaacta ttgccaacat tttttttgcag tagttgcaca gacggaaaag   13860
tctgacagcg ccaccacaat gtaaatagct tgtttcagaa acagttcgtt tttctaaaac    13920
aatttctgat acggccttaa ccagttgcct cataggaagt aaagtagagt tgtatacgca    13980
cagctgacct gtattcgaca agtgttatag taaaggaag ctaaatttgt ttcacaaagt     14040
tcttgtcaga gttcgcgtgc tgtaccgtga aacaatcaaa caaatatgcg atatgtcata    14100
catgtatact attttgttgc tgttcatttt tctgtactcc tgtcaaagtt ctaaacagtg    14160
gctgataccg acatattiac catatcttat cttaagtatc attttcacac atatatggcc    14220
gatatagacg atatatatca gctgacattt taccaatatt ttgcctgaca tcttggcaga    14280
tatggacaac tgtgtatcc ctccatccac aaataagtgc acgttactt gtcctttgtc     14340
aaactatttc taagtttgat cgacttcata gaaaaaagta gcaatatctg ttgcacaaaa    14400
ttaatatcgc taatttgtca agctgaacaa aatttgactt agggtaaagc taaaagtaca    14460
cttattcctc aatggaggga gtaggcaaca cattttcaa aatatttaag aaatgcatat     14520
tgtcggttta tatacatgcc taatttactt tcttctggta tcaatatatc ttacatagac    14580
aaatcctact acaagtcacg tgtttcacat aattgttttt ccaacatttt ttactacttt    14640
ttcgaaaatg ggcactttat tacttaacgc aatagacccg gcctctgcat aactaagatg    14700
catacagccg cacaaatatc tgttacaaaa ccacagtggt gttcgacgac aaaaacaaag    14760
tttgtggaag acaaaaagac tagctaggag catctagccg aaggtcacac tgccacccat    14820
gttgggacaa aatatccctc gccgtatcct ccaaccgtga agacacctcc gtaaagaggt    14880
ctcggtgctc cacacgctgc agtggcaccc atgaacaaag cattgttgtg caccggtaaa    14940
tgacctgcat aaaggaggaa gaaacattat tgaaaatctt gtcatttcta catagccaca    15000
```

FIG. 3 (cont)

```
gagaccaaat aa tgcaatc gctcccatcc taataagact aataagacgc ttaaacctaa   15060
aatccacgcc at gagccag ttgccaaata aattgacaat actacgtggt gggta aagg   15120
tataccctat ttggacgact gaccatatag acctagcaaa cttacattgg aagaa aagt   15180
gtttaatagt ctcgtcctgg gaagg ctcc aacaccttag cgatagtatc gctt  gtgg   15240
cgcactatat tg acaatgt cggatacggt tctcggagtg tggtattatc taaccattta   15300
tcctcgcaga aacgaatttc cgaccggttc ttaatagaga aagatccata tggaaagaaa   15360
tacttctttg tt cataag accagcccaa aaatgtggat ctcgtggttt ccaaagaatt   15420
tgagatatag cc ttgagcc aatatacttc ctcttgagga gtgtttgcca tataccctct   15480
ttggtaacta ac tggatag ccatt accg agaactgccc tattcttgac ctgga gtct   15540
tggatgccaa gtcctccatg atctt gggt cgacacagca cactccattt agtcagtcga   15600
tatttaccgt tc cactatc cccttgccaa tcttgattgg aaataatcca atct   ttaa   15660
gactcctcta ggaagttgga agaaaaatat catgtatagt accatgttac ttag atcgc   15720
attatgagaa ctaatcttcc tccaaggat agtaatatac ctttccaact gcttaatcta   15780
atttgtagtc tt cctcaac caatt tcat taggcattgg tgagtctcct ataa gaatc   15840
ggaattccca ag acctaat tggaaattgg ccttgaccgt agctgaaaag ctcagcataa   15900
tctgcaacat ga ctt gggc ct caccaaaa taaaacaatt cact ttatg gaaa  aatt   15960
tttagacccg acaaatgctc gaatgctgaa agaattagct ttagattccg agca  gtcg   16020
atgtcatcat ccataaaaag tattg atcg tcggcatatt gaagaatgga ta a tcca   16080
tcaacaagat gaggaatgac cccttcaatc tgaccatctg actttgcacg ttcaa caat   16140
acatcaagca ta cagccac tatat aaat atcactggtg ctaatgggtc tccc gtgtt   16200
agtcccttct tggtctgaa gtatt gccc acgtcatcat tgactttaat ggcagcactc   16260
ccacccgaga caaaactatt gatcaactac ttgattgggc atgcacataa atcc  ttgc   16320
atatagctat ct ccatgta gttccaattt ggcataaaga tcttgcatca ccggg ggat   16380
cagtggacac tt ataagct atata gttt ttatgtttac acttttgaga tttggcgcat   16440
gctagatttc tagccaagaa ttgtgcgagt gttcctggaa ggctgagggc gcgcgaacgc   16500
cctctaccgt ataccttttg tttttatcca tttgaaggaa tgcatattta atttagaaaa   16560
tatataatgg gggatgaact agatg ttct tgagcaagga tgaacttaga cctcaaacac   16620
tatgtgtctt ta ttgatta attgacaata attcataaa tggaagtttg gaacacttca   16680
acatgaaaca ct tggagaa ttcagaacaa tggacataaa agcacattat ttagc tgaa   16740
tttcttccac ggaaactgcg gcaccagctt tactccttca ttagcataga ctggcagatg   16800
gcatcgatct ctacagcgca ttcatttagc ctgcaatgac aagtaaaaca agtg atttt   16860
tcttcagaaa atgcacgtgt ttgctgcaga gataccagtt taagagatcg aacg gacg   16920
agttatatat acacatgtac ctctgcggtc tggtcatggt acttgccgcg gact  aaac   16980
tccacgttgt tgaagatact gttcatcaga atgtcagcag aatccgtgcc tgaaaccgca   17040
atgcaaatta gt aagtacg tagtgggaga tggcataata taacacttga cgatgggctg   17100
gaccgagacc tgcaaggtag gctag cgta cttgccctga acgtgatact tgcacatctg   17160
gttctgc cg cagtcgatca gaatt ccgc agagtcaata cctgcaagat aacc ccatg   17220
gacatagcca ttgtagtgct cgctggtgtg ctccccagtg aagtagaccc gccccaccgg   17280
cgcctgcagc aa caaa tt aaggacatca gacctagccg gccggagcca tta  cggt   17340
gatggacatt tcaccatcgg tgtag tgag atctcgatca aaaattcaat tcaactacag   17400
tgtgagtctg tg tctgtggc tacccgaagc tggtcgtatt cgtagcggtt gacgccgatg   17460
ggccagttgg ag aggagcc cttgaagaag cggttggacc accactgggg cacg agata   17520
tcggtggcgt cggggacgtc ctcgtcgggg aacatcctcc gcagcaccgc cacagcctcc   17580
gccatggtgg tg tgtccgg ctgctgctcg atccgccgcg actcctggtc cgtcaccgtc   17640
acgaggagca cg tggcccc cgggtactcc tcctcgaagg actgccacat cccg agtag   17700
cctcgcctgg agctggcgta gacgaagaac tgcttgcctt cgcccgtggg ccagaacttc   17760
cgagggaact tgaggaagat cttgg gtac actgccatgt cgaaccggta gatggcgatg   17820
attttccatg ct gcaggtc gatcgacata gcaaatgtca agagtatgat cga agtta   17880
gcagagtcgt gtgttgggtg tgaga ggca agctcgcaga gaccatgacg atag ctgcc   17940
tggtacactg agccgtcctc cgtct gacg gtgactccgc tcgaggagta ggaga tctct   18000
```

FIG. 3 (cont)

```
cgcaccacct tgttgagctg caggcgcggg tcggcgacgt tgccggagtc gtcggtgttg    18060
aggtactggc cggcgaggta gtggaccacg gactcgtagc cccgtttgtc ggcgacgaag    18120
tagacgtcat ctccgaagtc gctgaacgtc ctctggggaa cggcgttctg caggctggtc    18180
acgcgcggcg gctcggcgta ctcgtactca tacaggtagt agtctaccac catgtaatta    18240
gcgatcccgc ctccactatt ctcctctcgc agaaacccat cgctccccct ccccagcacg    18300
catccgtccc cggcgccccc atccctcct cctcgcggcg ccgcctcccc atcccgcctc    18360
ctcgccacgc cgtctcctcc ccccaccaca aacaacacgc cgcctcgcct gcccatcccg    18420
tccaacccac gccgtcgtcc cgtcgccgcc acatcgtcgt cgtgcgttat cccgccggcc    18480
actcgccgcc tccccatccc gctaaacccg cgccgccttc tccggccgtc atcatcccgc    18540
cgccgccaca tcatcgccgt gcccgatccc gccagccact cgccgtcgcc gccacccgtc    18600
gctcctcctt ttgctggtga caatcccacc ttcggcacca cgggatccct ctccaccgcg    18660
ccgccatgga tcctgcatct tccgctatcc ataagaaact agctagtagc tgatttacgg    18720
gcagctgagg cttgaactgt atgagatcgc tctgcaggac tcctaggctc gtggacacga    18780
tcacgtagtc cgcgctgtac gacgagttgt cctctgtgct cacgaccacg cctctccggc    18840
tgtacgagat ctcccgcacc acctgcagca ttgttcaaat ttatccaaaa aaatattaaa    18900
gatgtggttt ctttgatcac tcctacagta ctatgttcgt atggagataa attaattcat    18960
caggtttcaa ttattccagt atatgaatga attctggaaa gatagtgtgt ataggcatat    19020
aggatgaatg tgcgggcaga attcatcatg aaaaaggcgt ggtcaatagg gaaaatgagc    19080
atactggaat tgagcagggc ccattatttc gactcgaaac taaaatgaaa atgttccgat    19140
ttccatttgc agtatgcatg agatgagctg gacgaaatat actctaatta ttgtgctaca    19200
taaatttatc tgtgtagcac ctttattgca tgtatatctc aactgcccac gtcgagttca    19260
acaacactgt acagtgggca tccccgttga agaaagtgcc tcgagataac ttgtacttta    19320
tgtccggtga aaacccatga tctaactttg gtgtttacac tggtcgaaga tggcgcttgt    19380
acactactcc tttcctagat gtgccgttgt tggtggacct ctttcgccag cttggtgtgt    19440
gattattttt aaataatacc attttttaat cattttcagg aataatgcgt ggtttcaaaa    19500
aaaaaaaatc aatcggcgga cggcaggccg accgcaggtc tcagagggtc ctgaagattg    19560
gaaccggtc ggcggacagg ctgccgatca gccagccagc ttccgatcgg caagcacgtt    19620
gccgacgagg tgagctcgtg gcagtacatc agtccatagc ctccttcttt ctttattttc    19680
cctggtggcg gggcgtcctg atctctcctg attgatgtgt gcacatgcta agatgagacc    19740
tggtcggtaa ctattccatc ctcatgcacc aagcgatgtg tgcacgcact gagaagagac    19800
gtggggcaag gaaaagtgct cagcatgcaa ggaaaactgc tcatatgcat tcgtagttct    19860
tgattttgca tggaggccag gctagtcagt ttccgctgag cagacaaggt ctaatcggcg    19920
tggcctggca tttgttcagg ccgatcacgt ggttagtttc acttcgaccg atcggcacgc    19980
gctgaaaacc gatcggtcga aagatgcccg acgaagtcag aaaattgaaa tttttagaaa    20040
acgcgtatta ttcctgaaaa tgatttacaa attcgtatta ttttaaaaa tcgcccagct    20100
tggtgttgcc aatgggggtg gttgaccgct ttggcagagc catgcttttt gtgtgcaaca    20160
ttcgcatctc aactaggtct gaatattacg atggtatctt tttgatatta gtatattttc    20220
tttattaaaa atatacgtac aaatgacata taataagaag attaattttc attagcttca    20280
ttagcatgtg tttggcccgg tgatggacta tagtaatctt gtttagaaac cggtttatac    20340
acaaacgatt gcaatgcaat tcatcaaatt tcacaattc agttgcatga attttagaag    20400
aatttacata atacattata aaagagccg tatccaacaa gagaaataag ccattgtgcc    20460
cacatagttg gtctttagta gtgagtctat ctgtttggtg gtagcgtgtg ggtttgagta    20520
tgcatctaca ttataatagg tgtgtcacaa aaaacttagt tttgtcttat caaaaatcag    20580
tttattagtt ttacatattt tatttttat atatacccac tatgctcata actggatggc    20640
gcttagatat tatcggtctc cagtacaaca tcttgaccat tagttttgt aagcacatcc    20700
taaaaccatg gaaatttaaa atataaaaga atattatttc tcacaagaga tcttagggta    20760
ctatttatac tttgcaaaat taattaattt ctcggttttg ctgattctcg gctgagactc    20820
gtagatctta ggattgaatc gtgatttcta atagctatga gttgcatatg atttgaaact    20880
aagatttat tcagctacag atgggattgt agctgagaaa aatgccttgg gcagttcgat    20940
ttctttatga ctcgtgcaag ttagggttgc aatgagaaa aatgcaccaa accgttggat    21000
```

FIG. 3 (cont)

```
tgtttcgtga ctcttgcaat tcaccagttg gaattacaat tgataaaaaa tgtctcacga   21060
tgagaatttc actcccttaa ttttgtattt tttggtaatt caagctagaa aattcatgca   21120
attttgacca tctcctcacc acaagtttgt ttatattatt aattattagt atataaaatt   21180
ttaaaatgtt tttctcttcg gggaaaatta gtaaagtttt aggcttttcc gaaaatcagg   21240
tggagtacct tgttgagttt taacctagga tctacgatgt tcccggcgtt gtccgtgctc   21300
aggtactgtc cggcgatgtg atagacgagg gtctcgaatc cccgctggtc ggcgacgaag   21360
tgcgcgtcct ccccgaagtc ggcgaacgtg gcggtgggct cagtattctg caggctggtg   21420
gcacgcggcg gctcggcgaa ctcgtagtcg tacctgaagt agtccagcgc catgtccacc   21480
ggcgtcgccg gcccgttcgg ctggctgcaa aaaacagaa gaggtctctc atggacatgg    21540
tcaactgatc gatgagtata taactgtata tacaggctaa gaagacgcac gtactggttg   21600
aatatgcgct gcatggccaa gatggagatg tcgtcgcggc cgctgggatc catctccgcg   21660
gcgagcttgc cgcccagctc ttccacttcg tccccacggt ccatttctt ctgcacgtac     21720
tcctcctcgt acaggccgcc gctggttctc gtcaacaata gtacaaagca tgagattagg   21780
tttaacatgg atgctgttgg aacaaatctt gttattagta ctaagtttag agttcagca    21840
tgtttcattt tgattttgtt gaagtctgca tgtagtagtc gtctcagggt aggactgttt   21900
atgcatgtca tcatggtgaa gtggacggat cgatcggcaa tgttgcgagc tgatcggcgg   21960
tcaagagaaa ccactagttg cgagtacatg ttgtattcag tcaagtccta cactagtttg   22020
agtccaccgt cagtgcatgt agctaaggat ctatacgttg ggcgagccga gagactagcg   22080
ctatatgagc tgagttagtt gtggcatata cgtgatgttg atccatagag tggctgcatg   22140
cgcgtgtggg cagttagtgt tagtggtcta ctagttagtt ggcacaagtg ctgaacgtgc   22200
gtgcgtgcag taagtgtgga gtagaagtcg gatcaaactg gtgtgtggct tgaccgtgtg   22260
tgcgtgggtt atgttataaa agcattgtaa cctcagttgt ttcagtcgag agaaatacag   22320
agaaagaggc agacgtgtgt tgccgagaat acctgtgtgt tcttctccac catatatgta   22380
tgtgtgttgt atcttgggca attctgtcag atgcaacgct tcgttcatca tcagtcctac   22440
aacgatcgtt ttcgatggag taattagaac cacgacgtca aagatccggc gtcattacat   22500
taatttctga taatttttaa acttctcgtt cacgtcatca gtatatgact ctgtctgtag   22560
ttaatttgga ccctcttttt aatatcgtcc aatcattaga ccacatttct gcgcgtgcgt   22620
gtcatttcca cgtggtttgg gcagcgtgcg ttgctgttca tcaatcatca gttattatta   22680
ggtgcggtaa tatcgacagt taccggccca tcagctaaat ctttgttt cgttctcagc     22740
acgtgcatat atgttcatct gtttgggcat gcaggcatgc ctgtctaatg tctatgcata   22800
ttctagataa tcagtttttt cttcgaaagg tcttaatcgt cagtttggca gcatagatgt   22860
cttatatata cagtgaacgc acgtacttct ccttgtagac gctgctgacg acgccgtcga   22920
agtcggagta gaagttcctg agcttcagcg tggagttcac catgggccag atcgggttga   22980
tcttgtcccc gttgacgccc tccacccagt tggcgccgat ctccacgttg acgccgctga   23040
agttgtgctt gtgcatccgc ccgccgatgc ggtccgtcgc ctccaggatc agcaggtccc   23100
tcacgccggc gtcccacagc cgcttccccg ccgagatccc tgcaggcaaa gatgtacaac   23160
accgacgaca ttcatgtga cgtgtatggg tagcaaagac gttccacca aaggatgcgt      23220
gcatgctgat taggtaccgg acatgccggc gccgactatg atgaccctgg ggcctctgcc   23280
ggcggcgaga gaggcatgct gtgcagctat gagtatcaac actgctgcta tagcagtgac   23340
aaaggaagaa ggtttcatct ttcttctcac actaatctct ctggccttgc cgcgaatagc   23400
tagtttgctc cgatggacac tatcggtta agctgcgcat ctgctctccg gccgagccag    23460
tcagtgtgca cttatatagg gccagagagc agatggctac acaaaaccac tatgaattaa   23520
agacgcggga accacacacg ttccatatag agttaatacg attgcgacga aatcgaatgg   23580
tagctagaca cggtggatgg aggacgatgg tggcgccgat cttatcacat tgttggctt    23640
cgccaaggtg tttgaggcg tttctctggg atgagatatt gcgatctaat cttgtagtat    23700
aagttaacca gattgctaa ctcccagtcg actgagaata atccttgtta acatgaaaac    23760
cgttggattt tacgccaaga tatgtgcgtg cggattgcgg aatcatgcgt gacgttgtga   23820
ttgtcgaaat atgatgcttg cgttgttcgg cattctcact ttgttttgtt ttctgtttgc   23880
ccgtcaatg tgagtactga gtagtgcaga tgggtcttca ccggcggatt cggtattttt     23940
gattcttttt cttctatgc tcattttttc gataaagggg gatatactaa taccgcgaag    24000
```

FIG. 3 (cont)

```
ataccaatta cacccagcat ctgcgacaac gtagtgctct aatagcaata cggatgcaca    24060
cacccaaaaa aagaaagatg aattacagaa aagaaaagtc tcgcttcagt gaccaattcc    24120
ttgcagtagc ggacgaacca ccaccagaat agcaccagaa atccatcaac tccaaaagcg    24180
atgccttcaa ggaaacattg cacaagcgtc gacatcgccc taatcaaaga ccataggttt    24240
tcaccacgga gaaagtccgc actcccaaaa caatgccttt tcaacaagga cattgccatg    24300
cacaaccaat taaggccaga ccttggattt tcaccctgca agtttataca ctgaatttct    24360
cttgtgttgt tgcoctcact tgctaattcc gctgccgaat tcacgaatca cgaagccaga    24420
ctcactgcac caccaggact tagaactcca ttgccaatcc ccagttctcg gcttccatgc    24480
cattatccgc gtgtcagttt cccatggaac caacatgtcc catgatggca acagaccgca    24540
gagcttcgca acgcctcttc tgaaaccaaa cggtcagaat aaaacatggt tacacgcgat    24600
agaaatggca tgaaactctg gcaaactcca ggcatggcgt ccatttggaa tacgccggcg    24660
gattcgtatg gaactcagca tgcagcccta gatccaagac agctagtgac aacaaaatct    24720
tcatcacggt gagagagaag accaaggacc gccaccttta tttaatactg cgccggcagc    24780
ccccacgcca ccagctagcg gctaagaaga aaacaaatcc tagatgcgaa aacatgggcc    24840
gacatccgca tagcaggtag gcaccacgca acacgagct agggcaagat cgcttccaga    24900
atggccacc ccgcctccag tgccatgccg ccgccaactc aatgccgcgc cacgccggc    24960
catcgctgcc catgctgcc ccacctccat ccgctcctcc acgacacgtc catcgcccac    25020
caaagtcgta ccctgccgct cgcggagatc aatcgggaaa gccctctcat gccttcgcc    25080
ttcagcagga cgggtgtcat caccactgcc agcggaggca gcggcctggg aggccagag    25140
atgggggct aggcggcggc tgcagacctc cgggatcgcc cgagcggagg cggccggga    25200
ggttagaatt atgttgtgtg ttctgtctcg tttcgttaac ttttgtcgaa tgccctgaaa    25260
ggagacatac atcctcatgc atctctctct ctctctttct atctatctct ccctccctct    25320
ctctctctct ctctcttatt ttgcacgttg ctaatatccg tcgatctatt tataatcctt    25380
aacaactaca atcattcgag caaaccaaga taggcataac acaagatata tgagttttag    25440
gagtagattt cattcatttt ccttgaaaat ctaaaaatca tccaatagat atcaatacgc    25500
ctctaatacc aatacaagat ggtaatagat atgaatatag agaattaatt caaccatcac    25560
atagagatgg acaagatgg ccagagttca ccatcaccac ctaattagag ttattaaaag    25620
ccattgttca tgaatagata gaataaagtt caaattaaca cactacaaga aaacgggcct    25680
ttaggctcgg gacggcctct agtcccggtt gccaaccaa gactgcggaa tcgcgactat    25740
atatcatggg ggagtttgct ctatgtattc aacttctttg ttacttaaat tatttatata    25800
aactctctca aagagattat catcaattac caaaatggcg gagaatgaaa gtgcatagag    25860
tctccatgtg tggttttggt aattaatgac aatccctatg gaataatgtt tgcattgagt    25920
cataattgta ggagttgtcc ataggaaatg cttggaccat atgttggctt caacgttgca    25980
ataagaagaa ataaaatgaa agttcaagat gacccaactc gaagagatca tatccttgaa    26040
gcttgccttt catatggtga tcatggatat gtgaaaatat gccgaagaag aagctctccc    26100
atagtggagt atggggagc aattaagaat acttcatcaa gccagcacaa tcaagaaagg    26160
tgttccatct tgttgcggtc aacatcatca tcatcgagct caagtggaat gtgcaaggtt    26220
aaggttatat cttatagggt tttattcctt accggtctcg tggtttagtt gggacaccgg    26280
gttataggtt agtgccgca ctatcaaggg gctctctact gagtaacttg atcctatcgt    26340
tcggagagag ttcaaacctt tgcatccttg cataatcttt cttggttgtt atttggatct    26400
tatccatatg gtgttttaga gcttgtactt attctcatca caatccctag ttcatcgaaa    26460
acacattcca catgaaatac ttgttgtgtt ttcgatattg gagtttttcc cggttttcg    26520
ttttgagagg tttcacctct aaatgcatga aaaatctacc ccacttattc tttatatttt    26580
cactctttgt ggggtatctc gtgtcatcct atttacaact aaattggttt tacctaaatc    26640
tgagttttct aactcaagtt gttgcaattt ccttattaca ggtgttagcg gtttagctct    26700
tatagatagg ttaaaacttc cccattttga tcttatacac cgtagatgga ctatgatttt    26760
tccctacatg atcttgtaga tatttttcgtt gtgattccaa tgagcccgag atcatcaaat    26820
ttggagtcca gatgtgaaaa tgacgacgtt tttggtgtgc ggtacgctgc cagccgaagc    26880
ggtccggccc ccggtccgac gaaacgtcc cggctctcag attagtcgcc ggaatggggc    26940
tggggccggc cggacaagtc cggctgacca gaatggtccg gctaggcctg gaacgtccgg    27000
```

FIG. 3 (cont)

```
ccgggtgcga aaatgcagcc cttttctcca aacggctagt gctcctcctc ccatataaaa    27060
aggggccttc ttccccattg agcggctgct tcttctactc tctctctact ccattgttga    27120
ccttgagaag cttcctctcc ctataatccc tccatgattc ttgctcatat ttaagggaaa    27180
gatagaggag atctagatct acatcttgac caaataaatt cctctctttg tgagggaatc    27240
cactagatct agatcttgga gaaatttggt gtacctcctc ctatttgttc ttcctctctt    27300
attaccccaa tatcttttgt agctttgttg gaatttgata gagaatgact tgagcatctt    27360
tgtggtgttc tagacgttgc atttggtgca tcggtttgac ttctccacgg tgatacgtga    27420
aggtgaaagt tcgtgagaca tacacttcgg gagcttgttc ccggagcttg ttcctcttgg    27480
gtctttgaac catagacggc ttagtggtct ttgtggtgtt cttggggcct ccaattaagt    27540
agctttgtgc tttggcgctt agtggtattc ttggggcctc caattaagtt gtggagattc    27600
ctcaagggca aggcctttgt ggcaatttat tgggagcctc caattaagtt gtggagatag    27660
ccccaagctg tgtgcggtt cggtgaccac cctaaggttc catagtggat cgaggacatc     27720
cctttggtg ggaattctct agaagaatac cgtggccctc gtgcatttgg agtgacttgt      27780
cctccacacc gctccaacgg agagtagcac tcgcaaagt gtgaacttca ggatacatcg      27840
ttgtctccgc ctcacttcgg ttattcctat acccgagctc tttacttatg cattttactt     27900
tgtgatagcc ttagtcattg aagttatata tcttgctatc acatagttgc ttgaattgct     27960
tagcataagt cgttactgca tataggtgaa tcctagttat ataggttttg tgcttgacaa     28020
attaaacgct agttttattc cgcatttgtt aagctatatt cgtaaaagtt ttaaaccgca     28080
tattaacccc ccctctaggc ggcatccgtg tcctttcagg tgcaccctaa ttacatgcat     28140
gttagaacga ccttgtctcc atgttcttgg cattctcttc aagattgccc ttttttgatat    28200
tttattggtt tcacatgatg atccacctaa cgtctccgct ccaactcacg gaatacagag     28260
tggtgatgat gcaatttttct ctctctaatg ctaacacaaa catcaaaggt tggacccaca    28320
cgaatcttgt agcaactcat cttgtggcag atcatgcatg cacagctacc ctactagaca    28380
ggagacaatt ttcgatatat atatatatat attatatata tatgcatgct tgttcataag    28440
agaaattata ttatatatgc atcagcgttt acaatatgta gtagcgtaga gtccgtatac    28500
gaaaattgt ttgaaatgaa aaataattgg agcacaaaat gcaaacacaa aataaagggg     28560
ctaaaaccct aaaccctagc gcttccttta gtcccggtta aagttaccaa acggtactaa    28620
aggttctcta ccccgagcgt gcttcacaca cgatttattt aaactgagcc gttttctcta    28680
cgtctgcacc tacataaggt tagatcgcac acaattcatc tttgaagaag agttcataat    28740
atatttggtc ttagaacgga gggaaaccaa ttaatgaaac atgggttccc ttcctttttac   28800
aaaagaccat caataatatt tgggcattga tcggaagagc atcaatcaaa tatgattgcc    28860
cttcctgtta caaaaaggtc ggcgttaact tcacattaca tacatatata gggcctaata    28920
aagttggtaa taactatgtc atgtactaca catcctcctc ggaccagag gacacgcgta    28980
gatggcgctg gtgtctgatg catctccatc gtcaaaggct acgccctctc cggagcatga    29040
tgccacggtg tcgttggcgc aatggccact agtgcctgat gattctgctt cgaaggcagc    29100
catgcgcctt tccagcgcgt tcatccacaa ctcagcaagc tcgtcggcgg gaaattacag    29160
aacacgcact gcgcgccgg ccttcttaca tttcttctta gcgcgtagcc aagctgcagc    29220
cggtcctcgc ggagagtctc gaaggagtca tccaccacgc tatgcatagc ttcttcctca    29280
cgccacgtca actcgatgga ctactcgagc accatcttct cctctaagtc ctcctcaatc    29340
ctggctagat aatcctcgtc tgcagcgtgc ttctcctact ctagagggtg atcctcctcc    29400
gagtcatgcc ccgtgaggtc gatgatgctt ccccagcac tgatgtgttg tggaggaatg    29460
ctcgtcctcc gcatctgacg gtgcaaggtc gatgcaacct agagtggatt ggtagggagg    29520
catggtgcaa aggtgcgtag gctgccagag agaagagtga gcgacgcatt tataggcgag    29580
gaggtaaaca aggcgaacat tttgatttg catttcaaac aaaatcagtt aacttgcgag     29640
aacatttgat gaccaaaata tccgcaaacg atttcgcgga caaaaactat tgcacagta    29700
tagctgacaa cgtttgcgat accttcctcc gcatacaatt ctatttgaac aaattgtttc    29760
tgatatttta tcgtgcacgt atttggcagc cacatcattg cagcccatct ccgcgcgctc    29820
tttcatgtcc ttgaaattca tttcactttc ttcgttgtct tggttgttag tcagttggac    29880
ggactggtca tgctcctcct cggccatcag aggggcttgg ctctaaacgg cgacgttgtg    29940
cctgcggtac ggcgccacgc aagataggcg agcggtcttc ttggtgcgaa ccattacaaa    30000
```

```
gtaaactaca tgtgtaccgt aatggtgggg tgtgccaaac attgcggcgg tgtgggggg      30060
gggtctgtag cccggccaag gatccagctt gtcggcgatg tgtggcacgc cggaggaagg    30120
cgtagaagcc agtcgtcgac tgaaaattag acacacgact tttacatact gtaccatttg    30180
agtgcggcag aggagaagac acggtcaaga tttaaaactc ttcgcaaaat attcactatt    30240
cacacacgat aactttaccc atagtcgcgt gggatgaagg ccctattcgc tgaccattat    30300
ttttaaatag cccgtttgtg gactcttcct gactgcccgg aaataacttc cgtgtgcttt    30360
catgcattcg tataggcctg cctggagacc aagcacacgg ttcgtggttt atgcgtcat     30420
cgttcggccg cacaatacac aaaaggtct ttctatgtgc cactgagtcc ttaataggcc     30480
tgatctgtac tagtgatgcc ctgacatttt taaacgccga ggtatgcccg caatagctgt    30540
gctcgcacta gcccggcaaa acaaatccac cacggaaaac tacgttggaa aactgtaggc    30600
cctattttt tcacacgaca tatccctatc cactacgcac gagacgacta aaactcctcg     30660
gtacattaac aaacaatatt ttttttgtc atgcatagat aaggtgggc gcatttcccc      30720
ccgtgtttcg tgcacctgtt ttcgatagaa aagttaatcg caatcagta taaatatcag     30780
ttcatccatt ctgtttaaat tataatttcc atgtcattaa gatgataac tatatttcat     30840
tacataatat tagagtgcta ttgtttgact taatcaacat ctaactacct aattaacact    30900
aattagggaa aaaactccta tttctagttc tccatcaccg ctaatctctg gttgccttac    30960
accatgacct cgccgccata cgccatgacc tcgccggcga tcccatggac ctttgggagt    31020
tgttttcca gccatatta tgtagggtct gaaatgaaga gaatcatgat ttagaagaa       31080
aatgaagagg gagtgtgaaa taaagtaagg gcctaatggt agtgatttag tgcgatgtga    31140
ggtggggatt atgaacattt accggtgtgg atttagcatg tcggcaaac agagagaggg     31200
agtgcatgag atctagggtt cccagttgag tgtggagtgc ttgagatcta ggcttcatag    31260
ttgaacgggg attgcgtgac atctagggtt catagttgag cggggagatc gtgatatcta    31320
aggttccttg ttgagtgtgg ggagtgcatg agtctagcgt tcatatttga gtcggggagt    31380
gcgatggtat catgggttgt tgggattgac catagctaaa gcatcactcg caatgttttg    31440
ggagcgatta atcttaaaga taatacacag tcgaaccgtc cggcaaagtg ccttgatcta    31500
ggcaacaagg tgaccggac aagaacagtc cattgcagaa cttgtcacaa gccgcggcac     31560
atcagcacta cctgtttcaa tggtgattga gtcttggctc catgcaagg caaagggcta     31620
tgccctccat acactcacac agctcagctt ctagagctaa ctagcagtgc tgcaaggccc    31680
cgcatgcaga gaagatgatg tttcctcaga atctcctaag atcttacctt tcccagttgc    31740
gctcgtctgc tccagaaagg agccatccac actgagtgac ataggcatcc ccaatgggcc    31800
taccgaagat ggtaccggg gtttacagaa ggcccacaag tcgaagaata tgaagttcgg    31860
aagcccagtt agtattaagg aaagttagag ttgtattagg aaatatagag acttgtaatt    31920
ttacgggacg ggttagaaac cctcccggac tctgtaactt gtgtattacg aatccctcgg    31980
ctccgcctcc tatataaggg ggagtcgagg gacaaagaga ggatcgaatc cattgtcaac    32040
ataaccctag ttttataatc gtcgagtact tttcggctaa aaccttcgag atctacttgc    32100
cctctacttc caacgaaacc ctagtctaca atacgtagac attgataagt taataccttg    32160
tcaattggca ccgaccgtgg ggattagagg agacaaggag ctgatctcga tgcacgttc    32220
aagatcgtcg acttcgtcgg tagcaagcaa cgcattggat cgaggtaaat ggatcgaaac    32280
tgatctagtt gattttgtc ctcacccgcc ctcccgtttg gatgcatatg cgtatctgga    32340
ggagcccatg gagatgacgt tcggaaagtt ccgattctat gtcgagaaag aaggatcgta   32400
tcgtctcgaa gttccgatct cgtcgggatt atcggcggtc gatccgact tttcgtcagg    32460
cgagaggag attttgtcgc cacgcttcat caacaccgtg gcaagcgaaa agctcgccaa    32520
gatcttcagc gacatgtcct tcgagtcgtc tgcggactct gatataagca gtgactcaga    32580
cagcgtcgac agcttcaatt tcatcgacag atctattgtt attgaaaggt cttcaccaat    32640
ctatacgatg gtgtcaccaa tcctgacaaa aatcaaaatt caaaatatca tcagatctac    32700
gcaattgagg aaaaaaccg agcagagtcg gaaacatcag aggctttcga cgatgtggga    32760
aatccatatg tcgatcccgc tgatctcacg cgaggtctag gcactaaata tgttggcct    32820
acaccacgtc taagggttca gctccgcaa gaagcgtagg acagagccgc aacagccatg    32880
gatggtacag aaccaatgac cacaactgct acggtagaag aattgcaagc ttatcaatac    32940
agacttgctc gtgttagcag agagttagaa aaacagacag ccgcattaaa tacaagaaag    33000
```

FIG. 3 (cont)

```
gaggcagctt ccgcgtcaag caggcgaagg gcagatttaa gtcgacaatc aggaaattcg    33060
ggagatagtg atacgtctca aacgtatcca taatttctta tgttccatgc tagttttatg    33120
acaatactca catattttat acacacttta catcatttat acgcattttc cggcactaac    33180
ctattaacga gatgccgaag cgccagttcc tgttttgtgt tgtttttggt ttcagaaatc    33240
ctacacagga aatattctcg gaattggacg aaattaacgc ccagggtctt atttttccac    33300
ggagcttcca gaagaccgaa ggggatacga agtggggcca cgaggtggcg acaccacaag    33360
gcggcgcggc caaggagggg cccgtgctac cctatggtgt gggccctcg agcgcccccc     33420
gactctgccc ttccgc                                                    33436
```

FIG. 3 (cont)

```
gagaagtagt tgtgcttgat acgaccccct catacgtacg tacaggtgtc atcccagccg    60
tccatcctca agtcggacgg cccgatcac ccgtggaaac ggaagcgaac cttggtcccg   120
tcaaaccgtc cctcgtacgc cagacggagt ccctcctggc tcctcataat accctgcatc   180
tccctctct cttctcccca aacgacccaa accccacgcg gcgacagaac ccagcctcct   240
ccagtcctcc tctagggttt gcggccgccg gcggcgaaca ctcggcggcg gcgatggcgg   300
gccaggggca cgaccgcaag accatcgatc tggaggaagg atgggcctac atggagggcg   360
gcatcggcaa gctcgtcaac atcctcgagg caagaacga gccgcagttc aactccgaga   420
actacatgat gctctacacg taagcccgcc tcttcccacg ccgccggccc cggcttctaa   480
ctctgccggc ccgattcgat ccgatccgtt gctgatctag ggttccgcc tccctggcc   540
cgccctgatt tgttttcgtc tgttggcgca ggacgatata caacatgtgc acgcagaagc   600
cgcccaacga ctactcgcag cagctctacg acaagtaccg cgaggcctc gagaagtaca   660
tcccagacgc cgtaagctgc tggttccccc ttcttcccc tgttttttgt ttttgttact   720
gttatgccgg tgctttttgct tctctggtcc agcgaacga cgcgaatctg attaggattt   780
gctttctgtt tcgaacgtgc acctatggtt gtgctagtac tggctgcgaa tgattagact   840
atgctctttc gatttatatc tactaacgca cggtcagacc ctgtcaaaaa tcgttccttg   900
actatttgaa acaagctgac tcccagtacc tagtaactag tagqtttagt tcagctagtt   960
ttgcgtggat gcatcggtaa gttgctttt ttacttgaca atgtgctatg tttgtcagtt  1020
cagttaaggt ccctcctttt ccggccaaag ctgttataga atttcttttg ccatcctaga  1080
tagaagctat aaaagtgaaa cctgtattgc acaacagttt gcagtgtttt ccttgcttaa  1140
tttcttgagg tgaatattac ttttcttgca ttgtacagct ggaaacaatg gccttgata  1200
ggtccatgat aacgcaaact gttagttcta tactatctcg tcatgcatgc tgattttatga 1260
aagtaacttg tattcttgca taatccattg gcctcacttt agtttctcc tagtaatccc  1320
ttttgttatt tgtgatactg tgacctgatt ggatgatcag gggattagga atccaggtg  1380
ataattatgt tatgggtttc tgacataagt cacccacatc caactttttc tccaattatg  1440
ttgtactcgt tgtgttatcc tgttttcacg gtttaacttg ttgttcaaac tactacaggt  1500
cttccagca ataaaagacc agcatgatga gtatatgcta aaacagctaa acgtaaggtg  1560
gaacaaccat aaagtcatgg ttcgctggct ttcacgttc ttccattacc ttgaccgata  1620
cttcatcacc cggaggtctc ttactccact taatgatgtt gggttatttt gcttccgaga  1680
cttcgtaaac tgcctttttc ttaacttcat cctcctgttt agtgcacact aagttttttt  1740
tttctcttct aatcagtcaa ctcatggtaa cagatattc aagagatcaa aggaaggtg  1800
aaacatgcgg tgttagttct ggtgagtctt tgcatcccta gatgaacata tatcgaatga  1860
tttcacaaca tttaacagac ttttgcgaca acttctct gcagataaat caagagcgtg  1920
aagctgaaca catttgacaag accttgctga aggactcct ggatatattt gttgaaatcg  1980
ggttaactac catggagttt tatgagaatg actttgaaga tttcttgctt aaggatacta  2040
cagagtacta ttctgtcaag gctcaaaact ggatcgttga ggattcttgt ccagattaca  2100
tgataaaggt accttcaata agaccctttgc cctgcatat attttatgcat gtattttcttt  2160
ttgttctatg taatagattt gctgatgcct ctttcattag gctgaggagt gcctgagaag  2220
agacaaggag cgagttagtc actacttgca tattaacagt gagccaaagt tgctggaggt  2280
ctgttaaatg ttttgctgtac ctattcaaaa ctattttctcc actagtatat ccactatgta  2340
ttctgaatat gcattcatac tttttgtaacc agaatatct aatgatcttg ttcgagaaat  2400
gatgcaaaat agcgcagtct gtgaaataat tttatgtaat catctttcct tttcttacag  2460
agactgcaaa atgaattgct tgccaactat gcaacacaac ttctggagaa ggaacattct  2520
ggatgttatg cattgcttcg ggatgacaag gtttgctcag aacaaggcat atatatttct  2580
atacagtata cataattatt catgaacgca attgcccact cattcatctt ttgctacagg  2640
tggatgatct taaaggatg tttcactct tctcaaaaat cacccgtggt ctggaacctg  2700
ttttcaacat cttcaaaatg gtattgacta tagtgcacat tatctcggct ctcctttctg  2760
ttgcttgcag ttcactgtaa actataattg aattaaacac cttrgcagca tgttacgaat  2820
gagcgtacag ctttggtcaa gcaagcagaa gattctgcta gtaataaaa ggtgcagtat  2880
ttgctcccgc cattgcttca tttctgcact tatttttat tgtggttcag ttttttgaaca  2940
attcaattca cactgtagtg tcatgtagct ccactgtcca gtgacaccat tctacatcta  3000
```

FIG. 5

```
cattaatact cttaaaatag ttgagacctg actattggag ttgccaactg gcgttgagat  3060
tacatctgac attttgttta gtacttgcgt ttggtctgcc ttacgattga tggatgagct  3120
cctgccacct actggtttag ttgtgtcatt tgatttatta atttctgtg aataagtatg   3180
ctaatattag tcatttgtac agccagagaa gaaggagatg gttggaatgc aggaacaggt  3240
gtgtaactcg atttactgca cctctatcac gagatttgtt tttctaatgt gtgttatttg  3300
cctttaggt ttttgtcgg aaaatcattg cactgcatga taagtatgta gcatatgtga    3360
cagattgttt ccacggccat acactcttcc acaaggtttg ctggctgata cgttgtatt   3420
ccattttgcc cgtatagtag ttaaaattgc cgcctcatcc tcaaacttct ctttgttcag  3480
gcacttaaag aagccttga ggtcttctgc aataagggtg tctctggcag ttcgagtgct   3540
gaattgctcg ccaccttctg tgacaacatt ctgaagaaag gctgcagtga aaagctcagt  3600
gatgaagcca ttgaagatgc ccttgagaag gtacaccact gtcttcggat ttactgttat  3660
cataagtttg tagcagaaag aactctggtt tgatagtgaa taactttcag gtcgtgcgcc  3720
tgcttgcata cataagtgat aaagacctct ttgctgagtt ctacaggtga tttcttgtaa  3780
ccttacttgg tattttgcct atttagcctc catatcagga gggtttgtct tgatttagat  3840
cttagtattt atcttcaaat gtgtggaaca atttacagga agaaacttgc aaggagattg  3900
cttttgaca agagtgctaa tgatgaacat gaaagaagca tcctgacaaa gcttaagcag  3960
cagtgtggtg ggcagtttac ttcaaaaatg gaaggcatgg ttactgacct tactcttgca  4020
agagatcatc aaactaagtt tgaagagttt gtagctgaac atcaagagtt gcatcctggg  4080
gtagacttgg ctgttacgt cttgacaaca ggattctggc caacctacaa aactttgaa    4140
ataagccttc cttctgagat ggtaagataa cctttttctt gtggatttag cagcatgagt  4200
tacacgtatt tgttaacatg acagtatgaa acccaggcat caaagctcat ctttataatt  4260
ttgaaatgga aacttatact tctcaatacc ttcaggttaa atgtgtagag gttttcaagg  4320
agttctacca aacaagaaca aagcacagga agcttacctg gatatactcg ttgggaacct  4380
gcaatatcaa tgcaaaattt gaaaccaaaa ctatagagct catgttaca acatatcagg    4440
tattttgaat taagtcgtat ttagtcgctt tgccaaatgt gtacttctaa gttgtaacct  4500
gtctgacatt ttgacatcc ttttcttttg gcaggctgcg ttgctgttgt tattcaatgg   4560
agttgatagg cttagttact ctgagattgt aacacagctg aacctgtcag atgatgatgt  4620
tgtgcgtttg ctccattctc tgtcttgcgc taaatacaag attcttacca aagagccagc  4680
tggtagatct atttctccca atgatgtttt cgagttcaat tcaaaattca ccgacaggat  4740
gagaagaatc aaggtactgt cctagatttt ttttttggt ttcttagctg tcgtactccc    4800
atgggattat aggccatctg ctatctgcag tgatgctttt cttatgattg aatatttgac  4860
ataatgtgca gatacccctg cctcctgttg atgagaagaa aaaggttgtt gaagatgttg  4920
acaaggacag gaggtatgca attgatgcat cgattgtgcg tatcatgaaa agccgcaaag  4980
tcatgccca tacccagcta gttgcggaat gtgtggagca gctcagccgc atgttcaagg   5040
tacttacagt acatttctc ttctctacat atttggttat ggaatctagc tcttgctgtt   5100
gtggcgcatc atcaaattcc gtatcatcat ttttcctag ttgctcacgt ggtgttctgg   5160
ttgacttttc ctatccatat cgatcaacta cctttgcctg atgcctgata attacactct  5220
ttaagttgtt ttattattct accctcatca tgaaacaaaa gaactgtttg catttaccca  5280
cccttgaaaa agggaaggaa aacactaggc atgtactccc tctgttccaa attaattgac  5340
cttatcagca catctagaca tgttttagtg tgagccaatt aattaaagtt gctactgttg  5400
ctgatgaagt agctcattat atataaaaat agttgtatga ccaaactacc tggagtgaca  5460
tagctactgt agccgtttat ggttttgtag agtgcttatt tgttttgata ttttggttgg  5520
tttggaacta gcagatgttt agcctgaact gtttgtccta acctgatttt gtgcccactg  5580
cagcccgact tcaaagcaat caagaagcgg attgaggatc tcatcaccag ggactacctg  5640
gagcgtgaca aggacaacgc caacacatac agatatctgg cttgattgtt atctggggc    5700
aggttcgggg gcagctggcg tgtggcgttc atgatatgct ccagtgactt tgctgcgatg   5760
atgcagctta ctttggggat ttctgtcgtg tgccagttgc taccttcctg ggctggtctc  5820
attttgtaca tggggtcgt tggataggag cctatcgaga tactagtagg caaatcagga    5880
tcggtggagg caaactcttt accgcttaac gtgccttccc ttgcagtgct atttatatat  5940
cttagtactc gccacttgac ctagttaact tgttgccacg cttatgcttt gccgtgaaaa  6000
```

FIG. 5 (cont)

```
gtttctacgg cctctcttg atggcattto ctgtggttat catgctgtgg ttactigtcc    6060
accaaaattc ctgtaagttt gtgctgtttg ccgctctatg ctctcaaggt tctgctggcc    6120
tgtggttcct cgagcggttc cgttttagca tacatgtcag tgccttaatg cttcatgttg    6180
tagctggacg ctggcgctaa gtcggtgatt gtgtttggct gaggaagtat cctgtcgtta    6240
cagacctagg aatagcattg ctgccgttct ccctcctgat cgctgccctt tgatactcac    6300
catccatgaa ttccctctgc cgtcaagcct gcctctcgca ccttgctgga ttttctcacaa   6360
aatctttgtc tgccccctcc ccaagtcctg gagtgctgcc atcacatgcg ccaccactcc    6420
tctctgccgc tgtcttccett cccaatgctc ctcaccctcc cctctcgccc ttgatgcgac    6480
cccacacatg ctgcctgcta gtgagcttgg cagcgctgcc gtggaggctg gggcgccac     6540
ggccagtcct caccaccatt gaaggtctga gacgcctcg accgctgaat ctgcaagcca     6600
agttttccac gaggtggtct cctctctccg atctgccgtc cgccatactc taggttgaac    6660
cggctggagc ctggaggtat ggtctcctct gattctccc ttcccatctt tgcctttttct    6720
gtaattatat cgtctagcac aagctgttgg actgaatgtt tttagtggac tgtgcgtcta    6780
atttcgcatg ttttcgtcta cccaagattt cagtgcatat ttgtggtgat cattgattca    6840
taaaaagctt gagtcagcat aaagtaaaga agataaatgt aaggcttcat cgttaatgat    6900
aaaaggttgc tataatttag tgtacctaga ctcaccgagc taatactgtc accaaagcaa    6960
acaaaatttc agaagtagct ggtactgcca tttatttcat tccagtatga agtcaagcat    7020
tcctagaacc acaaatatgt atgaagtcaa cgattcctag aaccattagc aggtgtccaa    7080
tattacctaa agacacttaa tttatggcct aaaattttga gcaactttga accgcaaaaa    7140
tactttactc ttatccaaag tatgccattt cagttctgat tattgcaaca tgatacatgg    7200
tggtgaactt cttcatgtag cccaatcatt atgccttact gaaaaacaaa acacaagtat    7260
acttggttag tttcatctct ttccgcagttc ttgtcgaatt gagtctagct ggtttcttat    7320
ctttactaat ataccgggat aggtggtctt cgtaggtaaa aaaaccggcc caaattattt    7380
cctgtcaaaa aaacctgcta gatttgcctt ccgatctacc tttagattcg aaataataac    7440
caggaccgat cggcct tcac gcgtgaaaaa acccaggacc caaggcctt tgtatgcttc    7500
gttcgtacaa acaacaacaa cggtaggtgt tcctttgct ctgcgttgag acttcctct     7560
cgtcgtgaag cagttggcat cgaactccga ttcctaccaa atctatcgtg tcgtccaaga    7620
aaaactccaa gtcgatcgct cgatcgtgtt taggtaaggt tctttctcgt tctataaaaa    7680
atatcagatg gcaccggtat taccggctac cggaatggaa ataccagccg agatttttat    7740
tataaaattt aaatttatcc aaaattcgtc aaaattgaat agattacaaa aatttcagta    7800
aatacccgct cttattttct tatacggta cgtatgacaa aaccggttac cgccaagatt    7860
tcggaaatat cgggtgagga aaaacactag agcacattac cggtgcatgt ttaacgacat    7920
gcatattttt attgatcatt ttacgtcaat aactcttaaa tatatctaca ttattgaaca    7980
attagttacc cgtagcaacg cactggtatt gtcctagttc tagtatttcc taattctgta    8040
aatattttga cggattcgtg ttgcagaaca catcttcctc ctgtggtgag tgagccttgt    8100
tgagtttatt tgcattggtt ggtcattgct atgaaatttg tttaggttc catgtggctg    8160
atgttccaat tgttgctgcg cggacagctt caaaacatgc aacacagcgg aagcacatct    8220
gccatttgca caaaaaaggc acgtaaaata cattagtgat gacactctgt tctagaatga    8280
taacatacca ttgcagaaa aaacgcacgt aaaatacttt gatgatcccg tttacttcctg    8340
ggaatgcaga tgctgtttag agcatttctac taatctgatg cctggacata catctgtccg    8400
gtcaaaacaa atgcattgct ttgcaactt gttccatacg ggaaaacgag aatatcaagg    8460
tatttttgtaa tgtatttct gtgatcattc atagaatcat tccagcgtat acggctatag    8520
cttaatatga tgaattgcat attactgat ccagcgctgc tatatgattg tgaaagctct    8580
atgagtttt gattccgat tttagcctat cttactaac acagttgcct cggaacatat    8640
ttggccacac agttgttttc tctgaaatgg tttgtatatt cacttttcag tttaatttga    8700
ggatttaaag aaaacaaagc accgtactgt ttgactgtt ttttaaggct gcacatgtat    8760
aaccatttag tacatcagca agaaccacat gaggttgact aggtagaaaa ttacctaaac    8820
accaaaacat gttccataga tcggcgcaga gctcatcaga agaaatctaa atttggatc    8880
ccctcgaaaa aaaaatctgg aagtatacat gtccagtagt ttcatcaaag ctaaacttat    8940
acactgcaat gcatatctgc cattagataa cctgaatctt atgcaccgga gagctcattt    9000
```

FIG. 5 (cont)

```
atatgtatta atccatggtc ccaaagtgct gaaagagtat tctactacta tgtgccacca   9060
tccagtaggc cctgccgtca aaccatgtat tttttracta atgacaagtt aagctagatt   9120
ttacattagt tagttgtgtt tcaatggatt ttacacgtaa cttgatttgg crctggccta   9180
attttcagtt ataaaatcca tatttacttc tctacatcac tatgtttgtt trcgtaggga   9240
gcttccttga caagcaaagg catgcttctt gcactgccga agaaaagaca agtcatggtg   9300
tgttaattgg atgatgttct gcaattggtc agtgtgttag cgtgggatat agtatgggtt   9360
ttaattaact gcaaataata ttagttgtag gtgttcattc acttctgaaa taaacaattc   9420
atcgtatttt tatgaagtta tctactactt gacatggtta atttataagt attttctcaaa   9480
ctgtgtatag gtgtaatagt tgctaaaata tgttgaagtg gtcatcgaat atactttttt   9540
gctcctaaat tcttactaga agtttatagg tcattgtgac agtgacatat aaacttctag   9600
ctgaacatta atgaataaga ggttttgatt ttatatttgg tgtttttttaa tctctcaagt   9660
aactagggtt attgagtaaa gtagtagcaa caaattatgc atctatcaaa tctatggttg   9720
cggcaaagtt ttttttttgaa atggagaagc tattgtgaga aattgcctat gttgtataga   9780
cagaaattaa cttctgatat atttttcttttg tagtgagtgc atattgcaca gctgcgtgct   9840
tttgtcatac atcttctgca ttttttctatt tcattgcact tcactaatta aaaaagacc   9900
tttacatgca gccaaaacga aaatacgcaa gccaacattt ggagaatgtg taggaaaata   9960
tgcatgtttt ttggcaatat aacaagagag aaggtgcgca gcaatgcgcg cgaggttctt  10020
ctagttccaa gctaatctag gtcctctgtg gcctaatcct tttctggcct ccatgttgag  10080
tttctcagag cgcctctcta cctcaacttg acaggttgcc cgtgaaggat ggttttctaa  10140
ggctggaatg aggctgatcg gaaacattgc attttcctca caggcacgtc tgaaatttct  10200
accaacttga aattgcactt tccgaaagcg gtggattaga ttccctagca cctcaaatcc  10260
agaatttgct tccatgtaga aaagaacatt cctgcttaaa aaaagactga gctcgatcta  10320
gactaacgga taagaccgtg tagcaaaaat gatctcatcg aatgatcaaa gacatcgcct  10380
cgatcctatc aaggaaaaag tacaattcta ccaaaaccgt ctttgcttga gactcgttgg  10440
agatatcatt actagaaata atttcttagt attgtagcaa aaccatagca aaaaaatata  10500
gatatgtagc aaatcgccac ccgccacaac aaaaattctg aaaacctgat cccgttggtt  10560
gcaacataga gcattgtcat aagcaactcg gatcaccgtt gggtagcattg tcgtctgcca  10620
tttatagtac atcttccaga gttggtagca acgtcgtcga caaatgtagc accaccatca  10680
gcctacgata gcaacgctgt tggcctatgg tagcaccatc gctttaatga ccatcgcaaa  10740
aaaagatgaa ggtcatcctc acaacatggg ggcgacggtc cacaaaccgt ggggctcgac  10800
aagcaagcaa ggtggccgcc ggagatcaca ttccctagag ggtgcacccc accgccgtca  10860
gaactcacga tcacggttgt tgtagcaaga ggaagccgac gacgacaaag ctggatcaac  10920
aacgagaaa actaaaatca gctcgcccaa cgatcgcccc aagctctcca tgcccacgtg  10980
acacagagat gcggagggta ggcgctggat gtggaggact ggagagggag cgccacgaca  11040
gaggcatcgt attccgatgg atctccttac cggagtcgtc tgcaccagcg aacgatggcg  11100
agatctggaa gaaaaatgat taggaaattg gggacagaaa ccctcggagag tttgtatcgc  11160
gagagataag acacgaggcc gacaaatgtg gggcccagca ccaagcgtcg catgctcaaa  11220
gaggaggttg ccggatgttc cgtccccga aggga_ctaa tcatattcct ttcgaaaac  11280
tggattagac ataagaaaat attgattcag aggctatcat gagaaaaga acaccgactc  11340
aaaactaggg atcaaagtgt ttggcgccta ccatttccca tgcccttcat tcgtctgtga  11400
ttttctggaa aactgtgatt ggcacatggc accgacgtca cttaaaattc agacattctc  11460
attttaaaa tttggatggt taggatgata gcttgaaatt agcaacaata ttgatgaatt  11520
ggcacctctt cattcattcg ttcgttcgac cattcataat aagcgataca tcatttacga  11580
gaagaggtgc aatttttagga ggatgattgt ctaaccagtt acccgaatcc gaattctttg  11640
ccatatgagc ttattgtgat tgtttccaaa aagaaaagaa atcagttaga atcaagccag  11700
gaatcccgtc ttcgtgattg attgctccta ctcgtgcctc tatccaccgc acaatgtcgg  11760
cgcacattgc tagctcaacc attgcgtccc tgcctgctgt tacgccgccc ctctacttcc  11820
ttccttatc ctcgtcccaa agcttaagtt tgacatggcc atggtagttc ttcaaaatca  11880
gaggactaca atgtgccaag cctagaaga cgaggtacca acgggaacgg gctgatgtc  11940
attggatctt gcgcttggtg ttgcaacgtt ttcttgtatc tctacaagtt catgtcccc  12000
```

FIG. 5 (cont)

```
ccccccccc  cccacaattt  tcaatcttgc  atatgtgctt  ccaaattgta  agtttgtaac    12060
aaaccgatct  gccttttttg  tgtcaaagca  caagctagat  attgcaaggt  ttatgtgtgt    12120
tttgctattg  ttttgtgttt  cctcggatgt  tttcaacgtt  gtgtatgtgc  tttcaaatgc    12180
ggcaaacaag  catttggttt  gttgcattag  tattttttaaa  atgttgcaaa  tattttttg    12240
catttctttt  taacatcgtc  tgaatctttt  tgtcgtgtaa  tcatttcttt  tgttgcatta    12300
cctttttttt  aactattgga  aaactattat  gtagggttgt  aacatcttcc  cgaagaaaat    12360
gttacgacaa  gtatacccac  agatttgttg  cattactatt  ttataagatt  gtgaaaattg    12420
cttagtacta  tttttgtaac  atcttctaag  aaatattgtg  ttttctttgt  tgcaaagcac    12480
ataaccgccc  acatctgcct  gctcgcccga  tccgacgatg  cgggatatgt  cccgacccct    12540
tcctggacct  gtttatcacc  gaaaggacac  taacttaaca  tgcattttct  ttcacatggt    12600
agtgagccac  tggaataatc  aaatttctct  tattagagat  cgatcaacac  tagttcacaa    12660
aaaaatcggc  atcaaaattg  agacgcgccg  agaccactaa  actaattcct  ctatcgctgc    12720
atccatccct  aacctcccaa  tgagcatcgc  ccacgtacga  acgtgtacaa  gtccaagcac    12780
ggccatgcac  tttacgctgg  acacaaggaa  tgttcactct  ccactccgat  cgcagcttgg    12840
cgggctttga  tcagtcagac  tca                                              12863
```

FIG. 5 (cont)

```
ggctgtgtgc atccgtagtc ccattagggt ggtgcgttgt tgtagaggct gagtataatt    60
ggtatctttt gatattaata tattcccttt atcgaaaaaa aaactctcca caagagaacg   120
acaagtggcg cgtggcgaac caaccataag cggacaattt tcttatgggc aacacctatc   180
gcatgtggaa gcactctcaa gagcgacctc tctataatga cgattttcct tgcgaattat   240
attcctttg ttgcaaaaag tattatcttg aaaaatcatt gttgtaattt caatcctcta   300
gattcctacg tctaggttgc tgtcccacag catattctca aatcaaaatc aaaccaaagc   360
tgaaaaatgt caaaagaata tttgcaaacc caaacctaac agtagccttg ctagagccag   420
ggtctaccga gagcccaatt gatcggctgt cggcatacat atgcagatgg gtccaatgtt   480
gcgttgcgaa ccaaaaggaa tatctcttcg gagacaaagc tatgcggaca aggccaagcc   540
cacaagccca catatggagc tgccacagaa attattccag ctttcgtctc caatctccat   600
cgccctcccc ctcctctgtc gctcgctccg gtttctccat gtgtggacgt gaatcgcggg   660
gagcgcgcac ggcgcaccgc gtgctatata cgcgttctgc gcggagaacc atgccactcg   720
ccgaagaacc cagccctctg tgctctagcg ccgccgcgtt ccggcgactc ggcagtttgg   780
ggtgcaaatg ggggcggcgc agctgctgtc tttgtgcttg gtactcgctg cggtggcatg   840
gacgagggg cagcggcccc gcgcggtgaa agtggcgcg ctcttcgact acgattccac   900
cattggccgc gcggcgcagc tcgccatcga gctcgccgtc gacgacgtca acgcggaccg   960
ctccgtgctc gcagggacca agctggacct catcacggcg gacaccaact gcagcgcttt  1020
tgttggaacc gtccaaggtt ggttgggtct ttcattgtga tttagctctc atgcttgagg  1080
aactgcagtt tcattgctac caagtactaa tagttgagaa agatctgacg atagttaaat  1140
tcaagtaaat ttgatagagc aattgatttt ccagcatgca aggatgttag tatgggaagt  1200
tgctaattgt cgtatttcta aactagttca gttttttttt tttccgaatc tgaactagtt  1260
tagttggtta ataggtttgc ccctatgtcg gcataatcat ttcggaacaa caatgacaac  1320
aacaaaaacc cttaatcac aagcaagttg cataatcttg agataaaacc aaaagactca  1380
cacaaaccaa cagagcaatg atattaggat aggactaata tagtactagt gatcgtaatt  1440
ctaatagtac agtcaatgtt agcacatgga ttattaattt taatcacacg tgtcaaaaat  1500
cagatctgtt tgttcgataa tgggcttatg cagtccgtgt taatctacgc tcaggttgaa  1560
tttaacatag attgggact actctcaaaa cctttttgca tgcaaaaaat cctttttgtgg  1620
gaaaatccag ttgacacggt ggtatgcttt tttgaaatca agtttaagga aatggcacc  1680
aagccttttc actcgcactt cacatataat ctcataaagg gccaagactc cttcatgtaa  1740
gccgcggccc ttaataaaag ccgcttgtca tcggtctata atcagatgg ctgtttggga  1800
gatacgcctc acataggctt tagcaatgat tttttatttt gttttttaa acggagcaat  1860
caatttaaaa ttacattcat tggcgctcgg tggtatatgt gaccgtcaga ataagcacat  1920
tactggggac tactcaccat atgtttgcac catatctata attgttgttg gacactaaat  1980
ttcgaacaga agccaagtat tatgctttct tgtcttgtga gatatggcaa ttaagattca  2040
gtttatcaac tacagttgtt gattgcttca acagttctaa tcaatgattt ttttacccgc  2100
aaaaacaaac agttctgatc aatgaattct atttttgctg cagcactgca actaatcgag  2160
aaaaatgtgg ttgcagttgt tggcccgcag tcctctgtga taggccatgt catctcacat  2220
tttgttaatg agctgcatgt tccgctccta tcattcgcag ccactgatcc aactctttct  2280
gcatcggagt attcttactt tttaaggagc actgtcagcg attacttcca aatgcgtgcg  2340
attgctagca ttgcttacta ctatcaatgg aaagaggtaa ctgctatatt tgttgatgat  2400
gattatggga gaggtggggt gtctgccctt ggtgatgccc ttgcaacaaa gcgtgccaga  2460
atttcatata aagcagtaat tcctccagat gcgaacaaga atgtgatcag tgatactg  2520
tttaaagtta acatgatgga atcaagggtt ctggttgtgc atgtcaatcc tgatacaggg  2580
ctgcgattat tttctatagc taacgagctc cagatgatga ccggtggcta tgtctgcatt  2640
gtaactgatt ggctagctgc tgtcctggac tcctcaaagt ctggatatcc gaagagcatg  2700
agttatatgc aaggattaat tgcccttcgt cagcacattc ctgattctgc tgccaacaag  2760
aagttcatat caaatggaa tattgcggct cgcaaaagga aaattgcatc tggtttgaat  2820
tcgtatggtt tttatgctta tgattctatt tggattgttg cccatgcgat tgataaattt  2880
ctcaatagtg ggcagcagat caacttctct gcagatacaa gattgcacga ttcggataca  2940
agcattatca ctctgtcaac tctcaagata tttgatggtg gtgaacactt gctacaccaa  3000
cttctgctca caactttaa aggcctaaca ggtctggttc aatttgattc agaccgcaat  3060
ttggtacacc cagcatatga gatccttaac attggtggtt ctgttcctgg tttgattggc  3120
tattggtcta attattctgg cctttctgtt gctgctcctg aaactttgta tcagaagcca  3180
ccaaatatgt cgtcaagtgc ccaacagttg agcactatgg tgtggtcagg tggctctacc  3240
actaaaccca ggggtgggt ttcccaaac aatggccaagc ctcgagaat tggtgttcca  3300
aataaaccaa gtttcaagga attgtggca agtggcaaag gtcctgataa cgtgacaggt  3360
tattgcattg atatattcaa tgcagcagtt aaactgcttc cttaccctgt tccttccaaa  3420
```

FIG. 7

```
ttcatatcaa tcggcgatgg tatacataat cctaaatatg atgcatcat  taatatggtt   3480
gcaaacaatg tatgctctga ttctttgccc ttcttctttt gtcattttcc ttttgatcct   3540
atggtttcaa ttgcaacagc attataaata tggtttccac caatgcatgt ccaaataatt   3600
gctctgcttc attgatcatt ttttctttta atcctctgat ttccttttct tttcattgta   3660
gaccattgat gtagctgtag gcgacttcgc tattatcaaa aatagaacaa ggattgcaga   3720
attcacacag ccctatactg agtcagggat ggtgatagta gcgccagtga acagtcaac   3780
ttcaagtgca tgggcttcct ttaaaccatt cacattagag atgtggtgcg taactggtgc   3840
tcttttttgtc tttgtgggaa tacttgtttg gattctgcaa catcggacta atgaggagtt   3900
ccgaggcact ccacagcaac aagtccgaac aatattttgg tatgttctga ttgctattat   3960
agatttcttt tatcatatga tcatatctag ctcagaatgt aaatgcagac cacaaatatt   4020
agtaatgcaa aaaaatgctt catttttttc ataatataat ataatatttt atcttagtga   4080
tttctctatt tgttaactat atgtaacaga taattcatgt ttctctttca ggttcgcttt   4140
ctcaacaatg ttctttgcac accgtaagtc tgcatcacct gatgcatgc  ttaactcttc   4200
cattccatct tattttccat tatatttaag agaaaatcca tgttatttc  gcatcgtgta   4260
caaaacatct tactgtaata tcatctcagg agaaaacacc gtaagtggtc ttgggcgttt   4320
cgtcctgatc atatggttat ttgtggtgct gatcatcaac tcaagttaca ctgctagttt   4380
gacgtcaatc ctcacagtcc agcagctgt  aaccggagtt actggactgg acaatttgat   4440
tgcaagcact gtacccactg gacacccggc tggaaaattt atccgaaatt atctgattga   4500
agagctgaat attcatgaat cccgcctggt gccactgaac acgatccagg actatgcgga   4560
tgccctaac  cgtggaccaa aagctggtga tgttgctgca gttattgatg aaatgccgtg   4620
tgttgagctc ttcctgtcat accactgtaa cttcagaata glaggtcagg agttcacaaa   4680
ggagggatcg ggatttgtac gtacatcatg ccattataga ttttcatttc gattctcgg   4740
gacatcagtc tattagagga aacaaattaa cctgttcatc tcttgtcttt acagcattt   4800
cagagagatt ctccgctcgc tgcagacatg tcaacggcca tccttcaact ttcagagact   4860
ggccagctcc agagaattca cgacgagtgg ttgacgcgc  caagttgcag ctctgatgat   4920
agtgggttcg gaccaagcag gctagatctt ggaagcttct ggggtctttt cctgctgtgt   4980
gctatgatct gcctcttctc tcttggggcg ttctttgtaa aaataagctg ccagtacagc   5040
aggtactcca gttctgtggc tgctggcgac tccagtgaag cttctcctac ctcccctgct   5100
gtttctgaag tacacccgac gaaaccaaag ccaagacgtc ttgatagctt caaagatctg   5160
atgcattttg ttgacaagaa ggaggaagat gttaaaaagg aaatgaaaca gagatcaagc   5220
gataaagata atcatggcgt ggatcctca  gatacacact ttgtctcttc agcatagaag   5280
tttccttcag acagatctcc aggttctgac actgccaaca cacaaaagta gataaaacag   5340
aggtatattg gtagtacacg acacagctgc cattctcgtt gtgcctaata ggccgaacag   5400
tgggagtatt tgtgtctgaa ccacctccta atcagaaatg actaggattc tgtctgaaaa   5460
gacccttgtt gggctgtatg ttacgtttat gcgagtagcg acccaagagc   5520
ccatgtatgt ttatgtatac tactagtatg gtttatgtac tactgtatag ttctggaata   5580
aatttgaata ccagccacag ttttgaatat caatgaatgc attattcgg  ttgcacggtt   5640
catatttgaa atctatgctg cagccgttga cagttcggat ttaaagcata aaatgcgaat   5700
gggatgttat aagttttgga cttataaata tggacttgta acctgtttaa gtgcgtcctg   5760
ttattttcat agttttgttg actatgggcc tcttgaactg tgttgttcct agggccggcc   5820
cataggctcg gcaaacaatg tgctcacact gggccccac  gaggaaggcc ccggccccgg   5880
tactccagtt ctatactgtc atttgaaaat ttgtgtgcga ccttggaggc gattttctc   5940
tctgatgagg gttttcggtc ccatgccgct gttcattctg agtctcccgt ctccgctcgg   6000
gctgaccaag gggatgtcct acacagctgc ccagctttgg cggagcggtg ggatcgggtt   6060
gtcggcggct ggtcggtttt gtgctggtga ggaagtcatg gcgccgggat cgttaggcgt   6120
gaagaaagcg cttgatgtga agatcttct  ccgcaagttg catctgagtg atgtggagaa   6180
agaggagtc  ttcctatcca aggaggatcg tagcgatcta ccggtggtga agtggatggt   6240
cgtgggaaaa ctcttgtcga ggaagggttt cagtgcgcaa tctcttaagc ggactatgtt   6300
catggcctcg aacacaacac aacaagttac ttccagacgc attgagaaga atctcttgtc   6360
ttgggactgg aagcgcatca tggagaaagg tccctggctt ttccgagact gtgcgttgat   6420
ggttgaagag tttgatgagg tgacaactgt gtcgtcggtt ataccaaata aagttcaagt   6480
gtggattcag atacacaaga tccctcctct gtaccgaact gaaactatac taaagcagtt   6540
ggcatccatg gtaggggagg tgcacaagat ggagatgaag gtggtctatt ttggggagtgg   6600
tgagtttcac agggctcgtg tgaagcttaa tgcggaaagc ccgctgttga ggctgttaa   6660
tcttctcct  gaaggggagtg agagtttgtt catgcaacta cttttgaaa  gatcctaaga   6720
ttctgtgacc attgtggacg gatgggcac  agggtgctgg agtgtggaat tgtagaatat   6780
gaggctggcg acggagacct agcacccgga gactccgcgc ttaggggtg  gctatgtcag   6840
ggagcgagaa gggactggtg caaatcgtgg catggatggt cgcatgcaag ctatgttggt   6900
ggtcggtcac gctgctaatg gtcggcgcgg ccgggcttgc agcgcacgtg attcaggtac   6960
```

```
gtcggtgtgg aaagagaagt aggttgtcga cccaaatgct agcggcttga gaaagagatc    7020
ttctgctcag gcggggcttg cggagggaga gggcactgaa cttgatgata caaccagcag    7080
ccctcttatg cttgtagctg aggaggcaga tgtcaaccat ggaaaataca acacgaagaa    7140
gcagttgttg cttgagtcgg ctgtgcacgt tgaggctgcg gataaggagg tgccatcgct    7200
gcctgcatat gtcacaccaa gggagcaaaa gaagcaaaat aagatagaca agggtgcagt    7260
tgagacaaga acacaagcga agaatggagt aggctccgac tcggggcgct gccagtttgc    7320
ggtcagtagt tcgggccgta agggtagtat tgtcatctat tggaataata aaactaatgt    7380
taagatctta ccatatcac aatatcatat cgatgccatt gtaactgata atggaggtga    7440
gccttggaga ctcacacgtg tgtacgggga agcacaaacc caactgcatt ttaagacatg    7500
ggatatgctc aaatttatca aatcggcgtg tccccatcca tggatgtgta tcggtgattt    7560
caatgagttt ttacatcgat cggagcatat tggtgtgcaa gagcgcagtc tgacgcaaat    7620
tgcaggtttc gagaggtggt ggatgtatgc ggtctgtgtg acttggttt cacgggccgc    7680
agctggatgt atgagaagaa agtggccgc agaactttct cccgggtgag gattgactag    7740
gacttggcca cggcggagtg atgctcccgc tatccattgg ccacggtcga gaacttcgtg    7800
gccacatcgt cggaccacgg tcccattctt ctgcgttggg atccaaaaca agacaccagg    7860
ctgacgacgg atatgaagcg tactttcaag tatgaattaa tatggaaaat cattctcatt    7920
ttccttctat gatggtgcag acctgtaaca acccaaaaat ttcaaaacaa acaaattgaa    7980
ttttccctag tt                                                         7992
```

FIG. 7 (cont)

```
aagtaaacc acaaggttta aagtgcataa aagtcacaca ttcttattta aatcataact    60
tattaaatat atggaatatt ataaaactaa atccatttac attacgaatt atagttcaaa   120
ctatttgaat aaaactaact atgggtattt tgaaactcat atgatcatgc cttggtgaaa   180
tcaaacacca actatccaaa attgaggaat aaccctcaac cttgatcttt tgaccaatat   240
tataatccaa tcaaatatga tataataact catcaactat aataaaacca tccacaagat   300
atttagtagc aaatgccact tggctatcaa aaaatacatc atatgagagc ataatgatct   360
atgccacata cgatgaaaat atctacatga cttgctttcc aagctttgcc acctcatgct   420
caaaggattg ctatggataa gggcatgaca acaaagcacc ttactcatct aaccaacaca   480
agagtcacca cctatgtgtc atgatactag agcttgccca agcctataaa tagagccaca   540
cccttcatcc atttggacat cttgtaccat gctacaagga aaccaaacac ttgagacctt   600
ccatgtgaat tagctaggat caagatgaag aagctaggag gtggaggcat accacaagat   660
gcaggtttat cagattttct gaagaacagg ctacagaaga taccaaggta gaattattag   720
gcaaaccata tatttagagg atcatatcat catgtcttaa gtaggacctt aggatattcc   780
aagacattga caagtgagag aagttataat actaatcata gccatgttca tacaagaata   840
ctagagtagt actaatatta gttgtttaag acaacatttg atcttggagg tgagcaccct   900
attccaatag ccatacctta ggaaaccaat tctataatca tcacaacttg gtaattaact   960
ataaacccta agaatctagc tgaaagtgtt gagaggagta ataagagag attagtgaag  1020
aatcagttga tcatgtctaa tgcatgatca taccttgtac atatagatga taagttaaac  1080
ccatatgatt aatagatctc atctatcaca taaaataata agtatatcac tagtagttaa  1140
ccccaaacca atttctcatgc cttgtatgga ggagaaatgc catttaacct aaaccttgtt  1200
tatccaaaca ctagagccaa ccctagcatt gctttgatgc attaatccta acaaggtgag  1260
gaggagtaac cctagctagc caataaaaca taatcaaagc ttatgctcat atcctaatcc  1320
ttgttgtgt atcaattggg tgatcacaac taaaacccta gatcacttt gcatttcaat   1380
ccaagtatca cttttggataa taagtagaac cctgtcatgc ctcatgccta ttcatacttc  1440
aacaagtgaa gcattaccaa aacccttaaac ctttttacat aggatccaat ccacatgaaa  1500
taatatgcct acctcgtgta tcatgtatca caaatataaa ccaagccata tatacttagg  1560
actaaatgcc atttggtgag tagaatgaaa ccaataccct attctacttt gctatccaaa  1620
taatttgcct aagtgaacca aatgaatagt attttataaa atagcaccac ctcagcaaga  1680
gagttaatca tgatgagttt aggattcatt ttaaataatt caaacaagag tttgctaagc  1740
aagagtagtg aatatgacaa aaattcggac aataaaaaca agaaaaaata gcgagtaaaa  1800
aaatgaaaaa ctgtgctaga tccagatcta gatctggatc gagattttaa attttagtag  1860
tggcgcacct actttttatc tagtggtgca cctctcactt tcagaagtgc cgcaccaggg  1920
agctaatagt cgcgcactac gcgatgcgcc actactaggc caaatagcaa tgatgcatca  1980
cctggtaggc cactactaac agttagcagt gatgtgatac atggtgcgcc actgataggc  2040
aaaagtggcg cgccactaaa tcgccttttt ctagtagtta tgatttacca ccaaatgctc  2100
tagatgagtt cctagcttta tgggcactgg gaacactctt tgaaaaacta gggacattga  2160
tatgcttttt atcgcgcgct aataaggtgt tgcgtatttg cattacatgt ctagatcaca  2220
ctcttattct agctcaattg gatccagatt tgcattacat gcctggatca cacttgtatt  2280
tgcattacct attcagataa tcctattaga gaatataact gcacataaac cttctaaact  2340
tgttttctta atcaccccat tagaatatgt cagcaagaaa aaatgtaaac ttgtttaggc  2400
gttgtcttg agcttcaatt ccaagatagt cacaggtagg tgtaatatga atagtaactt  2460
tcacacaaca ctacgacaaa ctgaaaacag ttaattatgc tagcacgtat ggaggatcaa  2520
ttaagcaatt taccgtgcta aaaagggaaa aagaactgat acctcaaaga tactctgcag  2580
catatagcat cataaatcaa gtgagcttaa tgtagatata tccgttggaa gttggagtga  2640
ttctaaattc taagattaat cgggatgtga tcaaacaatg tacaaaatga cctcgtgcat  2700
attgcaaatg aatcccatcc atgattgttt cttcaaaatt ctcaaggatt tctgccccca  2760
ctcagctttt cttgggtccg cccctgcata gaagtagaac cgtagaaaca ccatgtggag  2820
gcaaaatccc ttcatcagag gaggtaataa tgtagagaag aacagacaat ccatgttgca  2880
tcatgagcat gtctatgaaa ctgagtttca tgttacttct caaaagttgc aaccataatc  2940
atgaagccac cacaacctac ccgatggtac tccatagagc tcgtggagaa ttacgggaga  3000
agatatggtc cacgaaggga aaattgaaag cagactaatc taatcacgaa gggaagatta  3060
acgggagaag atctaggcca tgcctcccac tatcaacctg gccgataggt gaccccaaag  3120
atgctctccc aagtcaagt taagtactgg tcagttctct caaagcagac aaagcaaatc  3180
acatatatgt gcaattaagg gtttgtgaat cggtttagtc ggatgttgtt tgtatgctgc  3240
ttccatgtaa gtaccaaaga aaatttagag atagtgtcta caataagctg tccattaggc  3300
tatttgtaaa caacgcaata aatcgacgtc ggcggtggct aaattgccgc cgcgtgactg  3360
ggattcgacc cgttgaacgc ccggtgcctg atggggcggc gcagcctag gttttcccgcg  3420
ttggtggcga caaggggggg gggggagag ggggcgacg gaatcgacga tggcaggaac  3480
gcgcacagag gatagctcga tgattggctt tcacgcgtgt agcctcggtt tgcgacacgc  3540
```

FIG. 9

```
tgaagtgaac acatcaaata tgccgcgctc gatagcgagt tatcccgtcc tgatttttt   3600
accgcgcaca cggttttaca tcgcctagag cgtatccgcc tcatgcataa aaatcagttt   3660
ttagcgtgtg gagttctttt taagcgcatc tcgtaaacaa aaactacata gatgatgtaa   3720
acaacatttt ttggtgatgt aaattttata ggcactcgat tttgaagagt ggacaaatgg   3780
aggccgagct acatgtatat ctttatttta aaattttgaa atcatatttt taagttttaa   3840
aaaaatttga aaaaaatcct agatgtagcc aatgatgaaa tctacaaaca tgcaaaattt   3900
aaatatgaaa ttcttaatac tttaggctac gctaacgata aatatgtgga tctgagaata   3960
gtgaatagtg cacatttcaa aactataaaa cctgtcagat tttgttattt ttgtttagtc   4020
tacaatacaa agaatttcac attgagattt ttcatgttgg ttgatttaat cattgtctac   4080
atctagtttt ttttccagat tttttaaaaa cttaaaatta tgatttccga aatttttataa   4140
aaataaagag tcacatgtgt ctccgtttgc agttttcctt gatttacccc cttcttgctg   4200
tctcgcgtct gtcccgtacc aactctctac gaacagaggt actcggcccg attagaggag   4260
tttggtggca gcggcggcgg cggcaacctt cacggcggtc ggaggtaggg acggcggtgg   4320
tggcgggatt gcacgacccc agctagttca accagttagt tcaaaacatg ttcagccttc   4380
taatccagtc cgtcgagtca cctgtgcccg acgccttcgc cgccctcccc accgccgacg   4440
ccgacgaagt cgaaccagc agctccaccg ccggcggcg cgcaaccgca tcaaatccca    4500
tctcccgcg ctccagcaac cctctcccct ccaccacctc cgccacaacc cctctcgagc    4560
tgcccggcgt accccccgcc gcgtccgcac gaaaccctaa gatccaccac acccgcggcg   4620
tcctccacct ctaccgctcc tccccctccc tgcccgcttc atcctacgcc tccgccgtcg   4680
ccgtcgccgc caccccctc tcttcctcct ccgggcccac cgccccaccg ctccaatgcg    4740
actcgctgct cccggtaaca attccgcctc gatttcttac tatttcctc gtttccccgc    4800
tcctcatttc atgtttcttg cagtcatggc gcggcaccgc cctccttgtg ctcgccgtcc   4860
ctacccgcgt ctcgccggag gacttcgtcc gcttttgcgc cccctacgtt gagcacgcct   4920
ccgagatccg tgtcatcagc taattttcga gcgcatacag ccgttgattg catttgatta   4980
tgcgcacata ccacttatct ccggcgtcat ggtcgtagcc acgatggggt ggaggaccgg   5040
tacagcgtgc ttgtggagtt tgaggatcaa aagagtgccc acggattcta cctggacctc   5100
aatggctgga ggttctcgtc ctcagaggtt gtaatattgc caattggtg ccagttggtt    5160
tgttgatctt gtgtattact gctgctaaat atgggaaggc cgtgcttgtt gtccatggt    5220
gcaggtagag gtgtgccatc ttctgtttat agttgctgtg caatacatgc catccgctgt   5280
gccaccagtt gcatctactc agcttccgac atgtcctgtt tgcattggtg agcttatttt   5340
cattccatct ttgatgtttc ttattcttac gcatatagac gagctagtat aacatccttg   5400
agttttatgc aaagtgcgct cgattttag ttatctcttc attagcagga gcaacttcct    5460
attgtagcaa tctaatattt cctccatccc aaaataagtc actcatattt gtctattttc   5520
acttgtacat acatactgaa gcgcgtctag atacatgcgc atgtagacaa atgggatca    5580
cttaatttgg gacggaggga gtacaaaaga tcaggcactt atgacatcag aaaaagataa   5640
ggcacttatg tcatcagaaa taccacctct gactctgagg tacatcgaat atgtctttcc   5700
tgagttttag tcccacgaaa cccacagcac ctcgagggaa atatcatgca tatggtttat   5760
tttgttgctc ttacagccac cttatggatg caacctctta agctactagg actacttccc   5820
atgtggatat gccatctaat tctgggacag catccatgga aataaaaaaa tggttatat    5880
atgaatctct gttgttzaaa tatatccgtt cacagatacc tatcctgttt actgggatca   5940
gtattccatc tctttgcctt ctcaatgttt ggaatttgtt ggccgtcgct ttagttattt   6000
atcttgcaca agtattaaaa tgaccaggct gctccttacc atctttatg tgtgaaccag    6060
aaaagttgga tcaagacatc agtggaattg tggcaaccaa ttgtgaccat tctttccagt   6120
gttcatgcgt ttcaatgtgg gtcagttcat cttgtccggt aaggaacaat cgttttaatc   6180
aacgttccac tagttcaatc gggaaatcga caatcactgt gtctcatatg aaagtaatta   6240
tttcttgttg ttgatttta cactgtaccg tttaccactg gaactactcg ttttgttaga    6300
actgtttaat gaagtagtac tggttctgca gcaatatcca atatattcat gtagtttctg   6360
agaccacatg tttgatttta tttgaagact tggactccct gaaactagta gtttcaggat   6420
tatttgcagg ttattaaata ttaaacattg tgctttgtgc tcataagaat aaacttcagc   6480
ttggtataaa taagcattga atgttcatga cttcttggaa gctgtttgaa tctaattatg   6540
taacattatt tgctctcatt ttatttacta ctgtagatca taaatgtgag aatgctggtt   6600
tataggcata tacgtatttca ttctagcact ctttgttgct tgtaagtata gagttaaatc    6660
accagtttgt tagccaattc ggtttattca tagttttttct ttactcaaaa gttgtctcca   6720
tttcaggttt gtcagttttc tcagaagcag tctgaaactc ctacaaatcc tacatgttct   6780
gtttgtcaga cctctgaaaa cctctggatc tgtgtgatat gtggttttgt tggatgcgga   6840
aggtatgtta acacccccta actgaaactg tatctatcat gactagtatg tcaggaatta   6900
agcatgttat acctattatt gtgctgtact gttgcactcc atataaatga ggatggaaga   6960
aaatctacag tagagcttaa gtatatcatc acctctactt ctcctggact ccctaatgca   7020
tgttttttat gcagtaaaac tttcctttg accattttta cctgaactca cttacaaact     7080
```

FIG. 9 (cont)

```
agacaaaaat ctcctaggag gtcagctcca ttgtaatggg ttcatctcta tagataaaca      7140
gtaactagta ctacctccgt tcttattaaa ttgacgcgat gtcaaggcta ggtagtacag      7200
attgtatgta catccagcgt cgattaaaca cggacggaag gagtacaatt ctaacgaata      7260
acttccaaaa atcattagtg ctgacacttg acaccattgc caatgctttg gctccgtcct      7320
tgtctgaact cgtcgtcact ctgctatgtg ctatgttaaa gcatttacca tgtttattta      7380
acgcagttgg tagaagtttc aattaaagga aaactacatt ggaggttaaa taaatgagtt      7440
ctgcttctgt caataatgcc ctgatccttc cctttatttg tgcttgttat atataatata      7500
ggtataaaga aggccactca attaggcact cgaaagacac tcagcactgc tattctcttg      7560
atttggaaac tcaacgtgtt tgggattatg tcggtgacag ttatgttcat cgtcttaatc      7620
actcgaaaag cgatgcaaaa cattctaagc tcaggtcaaa gtgtgaattt tctggggaca      7680
acgatgactt cgatatgggt ggagttatgt ttagcagcaa aactgataca gtaagagttt      7740
tggctctctt tgtgttgatt ctatgtaaca gcatcttagt aatcttgttc cttaaaatca      7800
tgtgctctgc tcttctcaac agatcgtgga tgaatacaac cgtcttcttg caagccaact      7860
tgaaactcag agagaggtgc agtcctctct cctttgtact ccctccgtct catgaaactt      7920
gtctgagatt taactaaatt tggatgtgta tatacatact agatggtgtc tagatacatc      7980
taaattttga caaatctaag acaactttag taggacggag ggagtgctat tttgtaccg       8040
tcactatcca acatgctgta ctagagatca gcattttttt cggagttata gtttgttata      8100
cagtgggcaa tgtagtatgt atctgaacca tatatatatg cctatgttca tatttgcagt      8160
attacgaggc tctttctgtca gacgctaaga aagataggga acacatttct gttgctgtcg      8220
ataaagctgt aaatgataag cttcaagaga tgcaacttaa gcttgaaaat actatgttgg      8280
agaaaaagaa agttgcagaa gtgagcctct ttaaatcatg tatctttcag ttattaatca      8340
taaccagctt gagtcttggc ataactgata tctttacctt atcctgtaga tgaatgaaaa      8400
actcatgaag agccaggata tatggtccaa cacagtaaaa ggaatagagg aaaggtatgt      8460
ttgttcattc caccagaaat tagtagcagc tcgctacatt catgatatgt aattgtgaaa      8520
gaagtcaagt aatgcaaatt ttttgggcg catcatggaa acagatactt gcagtgattt      8580
ggctaactgc ataaatacgt atcatgtaac agtctcatat ttaggatgtt aaagtaacat      8640
ttcgtatgaa ttccattcga aaatagcaca agattcatgt atcgtttctg ataaatctgc      8700
acgcacaggg agagagcgca gttgaggctg aaggatgata caattcttga cctggaagaa      8760
caggtgctta taatatttat tattgtttat tgtaaaagtt ccaccttaga gaggagtttc      8820
agtacagggg ctttctaaa cattccatgt gcaattccct gcagattaaa gacttcaagt       8880
actcgattaa gttgcaaaaa tcgatagaga agatacaca tgctgatgat ctcaaaggag       8940
gtatgctggt gccactggcc atggaatcag aatctggaaa gggtaaaaga tcgtcaacgaa    9000
gcaagaggag gaattagcgg cagccatgca actggcctct ttgttaacta gcaagacagt      9060
tgctaaaaaa aatgaactag caagacaggt gtgactttgt gggagaagcc tccttactgt      9120
tagtttctca ctgctacact ctgatacatt gtccataacg aaactacaat cgggatacta      9180
cataacattt aaaaaaatac agaatttgga cattgtgtag aaaatataac caaaccaaat      9240
ccaaagttcg tattacatac ccagtgaagt gtcaggaagt tgtatcaatg tataagcaca      9300
cattagtttta caatctgata aacacttcga aggtgcagag tttgagcatt atgtcaacat     9360
gtgtaaaaaa ggtaagcaaa ctatccatag tctacattac atacccagag tggaatttca     9420
gaaatccaag tggacataga cttaaacatt cagtacatac atgactggca gttttttctt     9480
gggacagatt acagcctgag catggcaaaa cgagaaccca acggtggccc aaacccaaaa     9540
tggcaacaca aacgcagcag ccctgatcac catgcgtttc tcctgcttct tcctccacca      9600
caggatctgg agcgggagca gcacacatgt tgccttgtgt aatcttgtga aggtttgtct     9660
taggtagctc tccatgctga aagacctgat gatagctggg ttaactacca aggtatcgt      9720
ccactcaact cattatggga gaggtccaag ctttctatct cctccatgac gccaaagcta     9780
gtagggattg tgccaacaaa gaaattgttg gacaggtgga tttgacatgg ctcagatttc     9840
caagctccca aggaattttt ccatccagca tgtttgcgga tagattgatg ccagacatcg     9900
aaacgaaaaa actgcaacag tgtgtagagg ttccttttcg tagcaaagct gaagccgctt     9960
aagccataga atgtacggta gcagtcaaag aaaaatctca tcgactgcct gaataatttc    10020
tatcatatgc ggcacctatg aagatatat tactcctacc aatacatgct ggtaacgaac     10080
ttgagagcct cttatgagac gagtcaatta tcctcaagta caggagtttg cacaggtttg    10140
gacccaatga aagtagccta atattgtcaa gataatgtac ccaatggagg ttgcctgtga    10200
actgattgtg agtaatatcc aaagcaatca gactggatgc attaggaatg agaaagatat    10260
gtcgccagat aaggaattcc cagaaaaatt aacataattg agcagcacaa aactacaatg    10320
tggtaaagat ccatataaggt tgttgcttga tatatctaga agtcaaagac ctgtcaagcc    10380
gcaaatttct cgatgaactt tccctgttat acggttgcca gcaaggttca gtaccagcaa    10440
acaagacata ttccacaacg agttatcaag tttgccagaa agctcattat catgcaaatc    10500
gatgaccttt aaattctctt ctgatagatc atgaggcacc ataccaaaaa aatttattac    10560
```

FIG. 9 (cont)

```
catctaggaa aaactctgac tcaatggaaa aattactcat cccaccaaaa accacaccac    10620
caagcttgtt gtttgatacc ctcaaggtca agagcatggg ataattagta aaaacacagg    10680
gcggaatttc tccagaaagt tcattgtttg ataggtctaa tagccccacg attcccccaa    10740
aaaactgtat tcaaata                                                   10757
```

FIG. 9 (cont)

```
cggcgcgcc cctgcaagct tcgtggcaaa ataggaccct gggcgttgat ttcgtccaat      60
tccgagaata tttcgttact aggattgtg aaaccaaaaa caacagaaaa cagcaactgg     120
cacttcagca tcttgttaat aggttagttc cagaaatgc acgaatatga cataaagtgt     180
gcataaaaca tgtagataac atcaataatg tggcatggaa cataagaaat tatcgatacg     240
tcggagacgt atcagtgaac cattgcttag cataagttgt tggtgcacat aggtgaacca     300
tagtatatag gctttgggct tgacaaagta aacgctagtt tattccgca tttgttaagc     360
ccatctccta aaagttttaa atcgcctatt caccccctct aggcgacatc cgtgtccttt     420
cagtttctac tagcaacgga gagcatacaa gatcacaaat aacatatgac atgaatatat     480
aatcaatctc aacatagtat tcaatattca ccggatccca acaaaccaaa catagatgat     540
tacataaaga tgatcttgat catgtagcgt agctcacaag atcgatacat gaagcacaaa     600
gtggagaaga caaccatcta gctactgcta tggacccata gtccagggat gaactactca     660
cgcatcactt cggacgcggg catggccatg tagatgcctc cgacgataat ttccccctcc     720
ggcagggtgc cgggaagagc ttagcaccc cccgagatgg gttctgcgat tgacgccgcg     780
acagaacttt tcgtcgatgg agactccggt atccaggatt tcccgagaa gatctataaa     840
taggcggagg cttgatgttg gttgggcgcc tggtgggccc agacctaccc tagccgcggg     900
ccaggtccaa gtcacgccta ggggtggtct ggccgacctg ctgcgcctct tcgtccccct     960
ctggacttcg tcttcgtttc ggtaaaatat tgacttcggc ttttgtttcg tccacttcgg    1020
ggaatatttc ctgtatatct tttctgaaat acaaaaacaa tagaaaacag ggactgtcac    1080
tatggcatct tgttaatagg ttagtgacga aaatcatgta aaagtgcaac gaactgtaaa    1140
caaaacacat atgaattggt gtaaaacaag catggagcat caaaaattat agatacgttt    1200
gagacgtatt agttgtcatc ctgacttctc aagtagactg acccaacaag tcatacccgt    1260
tgggtcgaca aacttaatat ccgcgctgaa ctacgtccgt aaccatgcca tgctaggaca    1320
tgaccatacc ccatagaatc atcacactac aacgttctga tgttgttccc tctgcgactc    1380
ggcgtacatc cacctccggg atgttgtccc gactaccatc cctaaccaca aatctgcctt    1440
gcccaaccac cataaatttg ccacaccatg aggctaagaa ctccaatgtg gcacctcaaa    1500
gaaagtaccg acatgtgtgt cgctgctttg cgctctagcg aagcttaggt tttcacccaa    1560
aaatcacagg accactgcg tgtgtactga tcatagatct aatgatgcaa ataaaagaga    1620
ggatcaaaga cgccaccgtt attgacaccc caccaccaa agtcacccgg agtgcaatcc    1680
aaccgccaac tcccgaggga acttgtactg cagcagcagc aagcagagcc ggctctgctc    1740
cgcctatagt cccacaacat gaaggccacc tccattttaa acttattgt tagattgtg    1800
tcatgtgatt tccactaaca caccattcaa atgttcctct cattttctct attacaccgtt   1860
gaaaaataat tttatgtgat ttttactctt acacgttgaa aattcatttg tgtcattttc    1920
actattgcat cgtactcctt ccgtataaca aagcatgttt taagtttgtc taaatctata    1980
ttaaaattta gataaagttc agacatcttt tattggacgg agggagtaca aaacatttat    2040
cagggaactt catgccattt gggtaaaatt gaatttcgaa tttaaacata tgatatgaaa    2100
ggttttttt ttgaacattg atatgaaagt gttgtttatt taattttggc acgccctcta    2160
tgttcgtttc tagaatacac gaacagaaat acggtcgca ccggaccgga ccgcaacccg    2220
gttctgccag acgaccataa taaaaccaca gcaccgcaca gggcgagatt tcaagtcctc    2280
tgctccgcct tcttcggaag gaagcaaagc cgatccgccg ccgccgagga agccatgcc    2340
gaggccgacg atgccgcggc cgccgccga cgcaccgtgg tcaccgacta ccgcaacaag    2400
ctcctgaact gccgcgagct ggagaccagg gtccgcacag gtaacacgac gcctcctccc    2460
ctctcatcgtg ttctgggtgc ttgttccatc tgtaggttg agactagttg actcgctcg    2520
agctatccgc gggtcctggc taggtgct ggccactgga agataggatc tggttttccg    2580
tgattattag catgcctgca ggctagcgtt ttccgttttg accaattcga gttcgggagt    2640
tgcgcgcttg cccctgccgc gaggaccgct tggctgttct tctcggctag gctcgtgctt    2700
ggttgctaat ttctcgctgg ggatgtcatt ttgcgttggt agggtgttct gaacttgatg    2760
cgggcctcga tttacgagag ctcagtggaa ttttacaaga tgggaacagg aggaatttgg    2820
gatgaagtgt taaaccatca gatcctcaaa ttacatgttg gcaaaaatta gtaaaaacat    2880
aacgatacca aacttttttt tttgtatcta cacacttaa gctgtagtct gtacatgctc    2940
tgagcctcac cgaacaatgt tgcattcaaa ttacttgtat aagtaagccg cagctaggac    3000
caagcatagc cagtagaaag attccaagaa catccatgga tggaacccaa acaaaggaaa    3060
gactactagc taggaccaag cattaccact agaaagagtc caagaacatc catcgatcga    3120
acccaaacca aggaaagact actctataca agctcatgtt cataaccatg tcactagcaa    3180
ctcaatacaa ggagcgaagg agaaaataga aaaataaaca gacacataaa catgaacttt    3240
ggatacatag accaccaaat ctgagatcgt tgacacctag tatctcgatc aggtgagcaa    3300
ataattaata atcttggata caacacagaa ttacaacttg acagaggaaa gaacagtcac    3360
tacccagtat ctcgatcagg tgagcaaata attaataatc ttttgagcca ggttttaatt    3420
cctagttttg cctcggtcta gcgcctatat cgcctaagcg catgcctagg tgtacttaag    3480
```

FIG. 11

```
cgactggata gcacgattaa gcgctaggtg ttttgctgtc gcctagcacc tagacatgcc    3540
tttttaaacc atgcttttga gattgcaatc gcctcaacag atcatgaaaa actagccaaa    3600
tgttattatg atgtccaggt ttagcactcc cgacaaacta ctgacttcac attctaaaca    3660
aataacagtt caaactttac catctcttgg aagtaacctc acaaacaaat ggaccagaat    3720
aaccaccaaa cagaataggg caaacttctc aaagtatcgt taaatactca tcctgtccta    3780
atctactatt aaaactgaaa catgtaatgg agtgactttc gtctctgacc gacagtaaaa    3840
agattgaaat gtgtagtgtt ctcctatagt tccttcgatc tgtgtgtaat tacctctaca    3900
atctgcattt aatccttgtc aagtggactg actgggattg attacctgac cacctgtgcc    3960
tttcatatgc caattatgta ctgaatctga cacatgcata ataacttgtt tcacttgtcc    4020
tgttgtccac atgtgcaatg gttcctgctg gatcgttttt tagataatga ttttgttgaa    4080
ctatggatga cattattcac agcttgttag atagctgttg tttgataagt ttacttattt    4140
atgtgcagct agggagaacc taaaaaaggc aaagaaagat tatgataaaa cacaagatca    4200
cttcaagtct ttgcagagtg tgggccaaat cattggtgaa gtacttcggc cattggacac    4260
tgaaagatgt aagtcaaaag gcttttttttt ttggttttga aacaaaaatt tctctgtaca    4320
aacaatgata caagacatgc attctattct taacaatcaa tttcatcatc atattgcatg    4380
ttattctgtg tagcaacatg aaatgttttt actcatggta ataaaccttt ttgttctcaa    4440
attagcgact gaaacctgtt tttgttgaag ttatcgtcaa agccagcagt ggcccacgtt    4500
atgtggttgg ctgcagaagc aaagttgaca aagaaaagct gacagctgga accgggttg    4560
ttcttgacat gacaacttta accattatgc gcactctacc acgcgaggta tatgggtatt    4620
ggcttttcat ctatcgttta gttgattatc ttttgaagtt cagtttgtag catgacgggt    4680
ttatttgcta actaaaaaac atgamcawmr trckmaytct gccacgtgag gttgatccdg    4740
tggtctataa catgctacat gaagaccctg gcaacgtcag ttactcagct gtaggtggat    4800
tatcggatca aataagggaa ctgcgggagt ctatcgagtt accgcttatg aatcctgaac    4860
tctttctccg tgttgggatt aaaccgccaa aggtagtttg aagaaaattt gttctttttga    4920
gataacatac tatgctgtta gskmakmsak aagmatkcmm yyttmwsaat cywgarwtct    4980
wtctwmrtry wgskattamw cmtycaaagg gtgttctgct ctatgcccca cctggaactg    5040
ggaagacatt gcttgctaga gctatygcta gcaacattga tgcaaacttt ttaaagaacg    5100
tttcgttttt tctttaacgc tgttacatgt tagcaatctc ttatttggac atctttaata    5160
taatattttg aactattttg cattgctaat gcagattgtt tcaagtgcta tcattgacaa    5220
atatattggt gaaagtgccc gtcttataag agaaatgttc aactatgcac gcgagcatca    5280
agtatgtttt attatgcttt gtttctatgt atatcttctt atcctaaaca tttcatttt    5340
gttcgaaaac tattaaaatc agaacaatgt aaacagtaaa ttgcatttct tcgctcgtca    5400
ccaaatatat tttgcttcca agtttgtgca tgaagtagct gcagaaagtc gattcattag    5460
gcgaacaaag caaactaaaa aaattagcgt ctgatacttt gcgagaaaaa tcaatggaaa    5520
catcttcact ttgaagttac tatgcatgtc tgaatggcac tctaagttct attctgtttt    5580
cmmctaaagc atatmattta qwcwastrtr tagtgtqwam tqwqstcrtc tcattaatqw    5640
kwtattttct ttytntgmwc stkwkswcya rccatgcatt atttttcatgg atcaaatyca    5700
tgccattggt ggccgaagat tcagtgtaggg cactagtgcw gaycgtgaaa tccaacggac    5760
attcatggag ctcctaaatc agttagatgg attttgatgag cttgggaagg tacatgtttt    5820
ttcttttctg tgtgcacgtg tgttatgaca gcatgttatg gtaaaacata ttaacaacta    5880
tgaataggta ttatacagtg ataatgatac gatgcttact tgtaactaga tgatttttg    5940
gttcatcaat tgtaatggtg aactagttag ttagttatgg aatcaatcta tcttgtctta    6000
tgagctactc cctagctcct aaaatgagtg tcccaactct ttctagattt ggaggtattt    6060
ataactaaaa tacatcatga taccatcgaa tctagacaaa gttgagtcac ttatttatcg    6120
acgcagggag taccttcttg cctacaaggt aaggctattg tatggagcag tttattactc    6180
atcaggccag ttgtcgaatg gcaacttctg tgtagaaact tcagaaatgt attaaaacaa    6240
gacattgaaa agttcaagat ggttgtcact gattgcttgt ctaatattat ggcgtgcaca    6300
tgtttggtga tgtacttaat gtctctcctt ttaatgtgaa ttatgcgtaa taagagtttt    6360
atgtgtaaca agagagctct tctgcctata aaggtcaaga tgattatggc gachaaccgt    6420
cctcatgtct tggatcctgc actccttcgt cctggacgct tggaccggaa gatagaaatt    6480
ccattgccaa atgaccagtc gaggatggag gtcctgaaaa tccacgcagc tgctatcgcc    6540
aaacatggcg aaattgatta tgaggctgtb gttaagctcg ctgagrggct tcaatggtcc    6600
tgatctgcgc aatgtctgca ctgaagctgc catggctgaa gcttaacac ctatgcactg    6660
tcgttccagg gcttcaacgg tgccgatttg cgcaatgtct gcactgaagc tgccatggct    6720
gccattcgag cagacgtga ctacgtcatc catgaagact tcatgaaggc ggtgcgbaag    6780
ctgaatgatg ccacaagct cgwrwcyary gcgcactaca gcgckgactt ygccaaggaa    6840
agccagtact caccatttta gttttctgat gatgatgaca aaatgattgc agccggtgcg    6900
```

FIG. 11 (cont)

```
aaagctgaat gatgccaaga agctcgagtc tagcgccac tacagcgcag acttttggcaa    6960
ggaataagag atcaaagtag gacaccactg tctaaacttg agacgatca ctgagcctt     7020
acttctacca tgcggagtt tgtcatcctg gcaataccag agcgatcatg tacgtttctg    7080
cattgtatat gcttgggat gtctgcccct gccgcacaag ttcgtctcgg cttcgttgaa    7140
aacagattcc atgtacacgc cggttcagtc tgaaactcgc ctacttgagc cacagctatt   7200
cttagattta taacgtttcc ttctcctagt tgcttggaat caagaaatgt tggaaaaatg   7260
taacaattgc aacttgtgtt tctgtcttct gttactctac ctggaatcaa ggaatgtcca   7320
agaaggaaca tttgcagcgt gtgctcctcc ctattactct accttggaat gtgcattgtt   7380
actttgccct gttgttaggg atatattcct tctgtgctga taatgacctg attcatgtgg   7440
aatttctgat tcatgtgaaa tttctgtatt acaaacttac tcgtgctgaa cgaatattgg   7500
ggttgcttgc ccaaacttc cctctatggc tctatcggta gatctcgtta cttttgcaca   7560
ataaatttgt taggaaaatg ctattttttc agacggataa aaaggaaacg tggtcggagt   7620
cgtcgccgcc acgcgttgcg tcgaaacgcc ctgtcctctc ccatcgctcc atctccgttg   7680
caccaatctc gaggctggag gcgcgctcaa aaccaaaatt agcgagcacc tggccggacg   7740
cggggaaacc gcccccatct ctcatctcga ttcggcacac aaggaaccaa accaaacatg   7800
gcaacccaac tttgatccat tcccatctca attctccgt gaattcttcg cgcaacaaca    7860
caggattgga agatcgatcg atccccaatt ctgcattttt tccatatata cggttttgat   7920
cgc*atg*acaa acctcaagag cgtggcgtcc acgtggcgg cggcgcagga gtgcgcgggg   7980
agcgctcggc acattgcccc gtcgccgatg aagctgctgg tgcgcgtcgt ggaggcgcgg   8040
ggcctgctgg ccgtgcaccgt caacggcacc agcgaccct tcgtcaagct gcagctcggc    8100
aagcgccggg ccaagaccgc cgtcgtcaag aagaacctcg cccccgtctg ggacgaggag   8160
ttcagcttcc tcgtcggcga cgtcaccgag gagctggccg tatccgtgct caacgaggac   8220
aagtacttca gcaacgacca cctcggaagg gtcaaggtgc ccctctccca ggtcatggac   8280
accgacggcc tctccctcgg caccgcatgg taccagctcc agccaaagag cagcaagtcc   8340
aagaggaaat gccgcggtat ctttctatct aatctatcta cattatgttt tgggtttcct   8400
cttttgtggt tctgttgatt cggttactgg ttgaatctgt acaagcaaat catgatatca   8460
tgcacaagaa aaaaagagca tattctggta atcttggaac catctaatta tctgccatct   8520
gcaggggaaa tctgcttgcg catatccttg tctacacgaa cgcacgtgtc cgaagaactg   8580
caccctctac ccgcccac ttcggacggc gtatcatcca gttcagacag gtcaatcggg     8640
accaagcgtg gagctctgtc aaccaccaac agctacattg acctctcagc cgtggccagc   8700
ttggaccgag gatcgcagag cagcttcgaa cggtcggcgg atagcttcgt ggagcagccg   8760
cccaggagca gcatcgaaca agcagtcacc cagcctgcaa cggccgctga aactgatgcg   8820
atggccaaca ccgtcgtcgat ggtagaggtc ttgtctccct atttcttcg gaaacctgtc   8880
gacgccgctg tgctgcagt tgtctctgat gccgagtcg tggtggatca gtccccggag    8940
ccgaaagcgt gctctgaaga acgtgaaggt cctgagaatc gcacgccacc tgagtcgagc   9000
cttgatgagc tactgaaaat catggagtcc aaagatcaag gcgctgaaat gccagctaaa   9060
ctgtctaatg gcgtctctgt tgacgaatct tatgttactg caccagccgg actgaatacg   9120
ctcttgtttt ctccaaattc agatttctgg ccggctgtag cagagctca aggaacaagt    9180
ggatttcaga ttgaatcgtg gaagatcgat agcaacgatg gttgtttgcg aagaacatta   9240
agttacataa aagctgcgag taagctggtt aaagcttcca aggccacaga agagcagaaa   9300
tacttgaaag cagctgggaa ttctttgct gtttgtcta ttgttagcac tcctgatgtt    9360
ccttgtggaa cttgtttcaa gatagagata ttgtactcta taacgccagg tccccagtta   9420
tcatctgaag agcaaacgcc acaccttact gtaagttcgc ggatcaactt tgttcagagc   9480
acaatgataa aaggaatgat tgaaaatggg gcaaaacaag gcatgtcaga aggttatgca   9540
caattttctg aagtactgtc ccaaaagttt aaagtagctg agcttgatga tgctaatgca   9600
agcaaagcaa acatttgcc ttcactgcat acacaaaaag aaccgagctg gaggctgatt    9660
gtccgcttcc ttgggaactt cacattcata ctctctgtta tcgtaggat atatattata    9720
gcacaccttc attgtcaaa gcccaaagcg atgaatgcgc ttgagtattt tggcattgac   9780
cttccgatt caattgacaga ggtcgtggtt tgtgctgtgt tgatcctcca gggacagaat    9840
atcatgaaag taatgaagcg cttttcgaat ccatggaaac aaagaggtag atatctcaag   9900
agccactatg ttactactc tgaaacgggt tcacatgatt atgtatgctc tttattagat   9960
ttatgcttat gttgcacatg ctgtaagagt caaagcgctg ttctaaaact agatgaggtg  10020
aattgtcttc tactgcaacc aaggacatt ttgctctcta tatatgtcct gatattgtat   10080
tgctacttgg tttcctttat aatatcagtt ccagttaaga attattggcc tttattttt   10140
cctttattag gtagtgatca tggagtcaaa gctcatgcag atggttggat actgactgtt  10200
gcacttattg agggcagtgg tatagtagct ggtgattcct ctggcttatt tgatctttat  10260
gctgttttta cttgcaatgc gaagaggaaa acaagctcaa ttaaattcca cacctctgat  10320
ccaaaatgga atggttagtt tcactccct tgatgttctt ttgtcagttt gtcctcagct    10380
gtgaagagca gccaatcttt tttgttatag tatcgcatta actgacctc tcatatgcat   10440
```

FIG. 11 (cont)

```
agaatgtagc tgacccattt gatgcttgaa tttctagaga tatcgaatt tgatgcaatg    10500
gatgatccac catcaaggat ggatgtggct attcatgatt ctaatcgatc cgatggagat   10560
cccattggtc acgctgaagt gaactttctg acaagcagtt tgtcagattt aactgacata   10620
tgggttcctc ttgatgggaa gtgtgatcca gcaagcaacc ctaagctaca cttaagaatc   10680
tttttgaaca actcaagagg aactgaagtt gtcatgaatt acccgtcaaa gatggggaaa   10740
gaagtcggta agaagctaag gacttcgaca acttttttgtc caaactttt tcatcatatc   10800
ttttatttct gaaagtacat atgacacaat gtgtagataa attcgcggtc agcacaaaca   10860
aattcagcat tccggaagct ttttaacctc cctccagaag agttctcat tgatgatttc    10920
acctgccatc taaaacggaa gatgccactg caggtattac tttctgatt gttttcttat    10980
gcgaaagatg ctattatttg agttgtcaaa gatttggtat gttgtctgac gtaatactta   11040
tatgagttca acatcagaag aaagaagaca tgtacatgca ttaccatact accatggaga   11100
atcaccgcga tagctttgca ttcatttgac atttgccgct atttgtatt ttctccattt    11160
tgtgctctct atagtaacaa agaaccgact cttttttctt tagggggcgtc tcttttttttc   11220
tccaagaata attggattct actctaatat atttggtcac aagacaaagt tttttcttttt   11280
gtgggaagac gtcgatgata tccaggttat ccctcctaca ctgtcaattg gcagcccatc   11340
cttgatggtc atcctgagaa aggatagagg gtcagaagca aaacatggtg ccaagggaac   11400
cgataacaat ggaagattga agttccattt tcagtcctttt gttcgttcg gtgatgctca   11460
caggtatctt tatccttcat ttgtatgctt ttgaggtcca gtgagacatc tggcccaaac   11520
ttatacagta ttattttttc agaacttaca gatccaaatt tcgaaacaaa agaaaataat   11580
taagatattg tttcctgaag ttcaatatat aacctgttca cgtgtaatct ggcctgatgt   11640
gaatacactt tggttcgcag tcttgaagca cgaagctgtc ttggcctgat aatgaagatt   11700
ataaaagaat aatatttttct atagttaagt atagtttttta ttatataaaa ggtatggttg   11760
taaacatagg aaatctgaa cattataggc tttttgggga tttgaaccta aggctgttgg    11820
gcttggctcg tgcagagcag ttaaattgaa tttgatggag attttttctt atgaaatatta  11880
aaacaagagt ttgcattacg ataggtataa gggtcttgac cacagacgtc aaatcccaat   11940
aagacaagga tttagatgct aggccccggg cggcccagca cttcatcttt ggtttgtgcc   12000
accaaagcct gccatgctct gtctttattg ttgaagacat ctctttaga attcccaaac    12060
tgccaagatg agcacttaaa ctggacgatt tttaggaacc gcgcaatact tcatattcag   12120
gttcttctat acatacacaa cctcatggta tataaataag caaacggagt aacaatacat   12180
ttatactttc tatcgattat aaatccgccg ttcgtatttt cgaattcttg ccatgctact   12240
acctactaag ctattctgct ggtttggcaa tgaatttatt acactgataa acctttatct   12300
gacagaataa ttacgggat tggaaaaatg cggtcaccgg gtccagaaca gaaggggggag  12360
ataatggagg agtctgaact gaaagaactc ccggccgaag aatcagggtc cttatttagc   12420
catgaagatg tcaaaatgtc tgaaatattc tcatcagttc tctctgtgga cgtgagtgtc   12480
acttttacct tcacacgagc ttgtcactat ccgttttcac actaaataat ctgtttttggg   12540
attccctatg cacatctgta ttttcaggtt atttggaaaa tcgatacacy gagtctcaga   12600
acagmagggg gakatratyg aaaargagtc ygawmysaaa gaactccags ycgaagaaks   12660
tggawcctta tttacccatg aagatgtcaa aatgtctgaa ataitctcrt crgyyctytc    12720
tgttgatgty gagtccttga tggagatgtt ttcaggaggt cagttgcaac acaaagtgat   12780
gcaaaagact ggttgtatgg actactcgcc aacagaatgg gaacttgtaa acagaaatat   12840
ataccagcgg caaatcaaat caactacaag tttgacaaag catigtcttcg atctggagga   12900
gaagcaagca ccactcaaca gaagtatgcc ctagtgaacc aagatgggtc ggccattgaa   12960
gaggtgatga cactccaagg tgttctactt ggggactact ttagtgtaag aaacccttttc   13020
cattcttcta tggtctggta catatttcaa ccattgctac aagtttgaca aavcattvtc    13080
aagatatgga ggagaagcaa bcaccactca gcagadgtat gctctagtga accaagadgg   13140
ctgggccatt gaagagtgta tgavcctvca aggtgttcta cttggggact gcttcadtbt   13200
dcagctccag ctgaagtatc atatggcgaa cgtaccgbca aaaccaaaca cctgcagtgt   13260
gcaggttttg ttggggattg cctggttaaa gagcaccaag caacaaaaga aggtcacaaa   13320
aaatatcatg tcgaatacct ctaatagatt gaaggagcta tttctgaag tcgaaaagga   13380
tcttacgtca agaaacggta ccctttttag cgcatctatt gatccttacc gttctttaca   13440
tgatcctaat atcacgtaaa gtcatagcag aactcgcatc aaattaagc caggaaagca   13500
aatgtatatg atcttttttca ttcctaccta tgaaatgaat tattaccact gagtggaaac   13560
taagaaaata aatctggtgt agtttcatat gaacagtgac agaaaaagac tgaaacaact   13620
cccttcattt tgtctcaggc aagaatgaca ctgattttttc tgtctgtgac aaatttctag   13680
gtgcaagcta acctgtgtac agcactaaca gtaggttgac cattccatca ttgcaattcg   13740
ttttaagagc ccagcagaga ggggaatagg caaagtgtac atccttgcc gtctgcttgc    13800
ggtgcgacat gcttcaacta ttgccaacat ttttttgcag tagttgcaca gacggaaaag   13860
tctgacagcg ccaccacaat gtaaatagct tgtttcagaa acagttcgtt tttctaaaac   13920
```

FIG. 11 (cont)

```
aatttctgat acggccttaa ccagttgcct catagqaagt aaagtagagt tgtatacgca    13980
cagctgacct gtattcgaca agtgttatag taaaaggaag ctaaatttgt ttcacaaagt    14040
tcttgtcaga gttcgcgtgc tgtaccgtga aacaatcaaa caatatgcg atatgtcata    14100
catgtatact attttgttgc tgttcatttt tctgtactcc tgtcaaagtt ctaaacagtg    14160
gctgataccg acatattag catatcttat cttaagtatc attttcacac atatatggcc    14220
gatatagacg atatatatca gctgacattt taccaatatt ttgcctgaca tcttggcaga    14280
tatgcacaac tgtgtattcc ctccatccac aaataagtgc acgtttactt gtccttttgtc   14340
aaactatttc taagtttgat cgacttcata gaaaaaagta gcaatatctg ttgcacaaaa    14400
ttaatatcgc taatttgtca agctgaacaa aatttgactt agggtaaagc taaaagtaca    14460
cttattcctc aatgcaggga gtaggcaaca catttttcaa aatatttaag aaatgcatat    14520
tgtcggttta tatacatgcc taatttactt tcttctggta tcatatatc ttacatagac     14580
aaatcctact acaagtcacg tgtttcacat aattgttttt ccaacatttt ttactacttt    14640
ttcgaaaatg ggcacttat tacttaacgc aatacaccg gcctctgcat aactaagatg      14700
catacagccg cacaaatatc tgttacaaaa ccacagggt gttcgacgac aaaaacaaag     14760
tttgtggaag acaaaaagac tagctaggag gatctagccg aaggtcacac tgccacccat    14820
gttgcgagaa aatatccctc gccgtatcct ccaaccgtga agacacctcc gtaaagaggt    14880
ctcggtgctc cacacgctgc agtggcaccc atgaacaaag cattgttgtg caccggtaaa    14940
tgacctgcat aaagcaggaa gaaacattat tgaaaatctt gtcatttcta catagccaca    15000
gagaccaaat aattgcaatc gctcccatcc taataagact aataagacgc ttaaacctaa    15060
aatccacgcc attgagccag ttgccaaata aattgcaaat actacgtggt gggtataagg    15120
tataccctat ttggacgact gaccatatag acctagcaaa cttacattgg aagaataagt    15180
gtttaatagt ctcgtcctgg gaagtctcc aacaccttag cgatagtatc gctttgtgg      15240
cgcactatat tgtacaatgt cggatacggt tctccgagtg tggtattatc taaccattta    15300
tcctcgcaga aacgaatttc cgaccggttc ttaatagaga aagatccata tggaaagaaa    15360
tacttctttg tttccaaaag accagcccaa aaatcggat ctcgtggttt ccaaagaatt     15420
tgagatatag cctttgagcc aatatacttc ctcttgagga gtgtttgcca tataccctct    15480
ttggtaagta acttcgatag ccatttaccg agaagtgccc tattcttgac ctggatgtct    15540
tggatgccaa gtcctccatg atctttgggt cgacacagca cactccattt agtcagtcga    15600
tatttacgct tctcactatc cccttgccaa tcttgattgg aaataatcca atctttttaa    15660
gactcctcta ggaagttgga agaaaaatat catgtatagt accatgttac ttagtatcgc    15720
attatgagaa ctaatcttcc tccaaaggat agtaatatac ctttccaact gcttaatcta    15780
atttctagtc tttcctcaac caattttcat tagccattgg tgagtctcct ataatgaatc    15840
ggaattccca agtacctaat tggaaattgg ccttgaccgt agctgaaaag ctcagcataa    15900
tctgcaacat gatcttgggc ctcaccaaaa taaaacaatt cactttttatg gaaattaatt   15960
tttacacccg acaaatgctc gaatgctgaa agaattagct ttagattccg agcattgtcg    16020
atgtcatgat ccataaaaag tattgtatcg tcggcatatt gaagaatgga taaacttcca    16080
tcaacaagat gaggaatgac cccttcaatc tgaccatctg actttgcacg ttcaatcaat    16140
acatcaagca tatcagccac tatattaaat atcacgggtg ctaatgggtc tccctgtgtt    16200
agtcccttct tggtctggaa gtatttgccc acgtcatcat tgactttaat ggcagcactc    16260
ccacccgaga caaaactatt gatcaactac ttgattgggc atgcacataa atccttttgc    16320
atatgctat cttccatgta gttccaattca ggcataaaga tcttgcatca ccggtgggat    16380
cagtcgacac tttataagct atatatgttt ttatgtttac acttttgaga tttggcgcat    16440
gctagatttc tagccaagaa ttgtgcgagt gttcctggaa ggctgagggc gcgcgaacgc    16500
cctctacgtc atacctttg ttttttatcca tttgaaggaa tgcatattta atttagaaaa    16560
tatataatgg gggatgaact agatgtttct tgaccaagga tgaacttaga cctcaaacac    16620
tatgtgtgtt tatttgatta attgacaata attacataaa tggaagtttg gaacacttca    16680
acatcaaaca ctttcgagaa ttcagaacaa tggacataaa agcacattat ttagcttgaa    16740
tttcttccac ggaaactgcg gcaccagctt tactccttca ttagcataga ctggcagatg    16800
gcatcgatct ctacagcgca ttcatttagc ctgcaatgac aagtaaaaca agtgtatttt    16860
tcttcagaaa atgcacgtgt ttgctgcaga gataccagtt taagagatcg aacgttgacg    16920
agttatatat acacatgtac ctctgcggtc tggtcatggt acttgccgcg gactttaaac    16980
tccacgttgt tgaacatact gttcatcaga atgtcagcag aatccgtgcc tgaaaccgca    17040
atgcaaatta gttaagtacg tagtgggaga tggcataata taacacttga cgatgggctg    17100
gaccgagacc tgcaaggtag gctagtcgta cttgccctga acgtgatact tgcacatctg    17160
gttctgcgcg cagtcgatca gaattccgc agactgcaaga cctgcaagat aacctccatg    17220
gacatagcca ttgtagtgct cgctggtgtg ctccccagtg aagtagaccc gccccaccgg    17280
cgcctgcagc aatcaaattt aaggacatca gacctagccg gccgagcca ttaattcggt     17340
gatgcacatt tcaccatcgg tgtagttgag atctcgatca aaaattcaat tcaactacag    17400
tgtgagtgtg tgtctgtggc tacccgaagc tggtcgtatt cgtagcggtt gacgccgatg    17460
```

FIG. 11 (cont)

```
ggccagttgg agtaggagcc cttgaagaag cggttggacc accacctggg cacgtagata   17520
tcggtggcgt cgggcacgtc ctcgtcgggg aacatcctcc gcagcaccgc cacagcctcc   17580
gccatggtgg tgttgtccgg ctgctgctcg atccgcgcg  actcctggtc cgtcaccgtc   17640
acgaggagca cgttcgcccc cgggtactcc tcctcgaagg actgccacat cccgtagtag   17700
cctcgcctgg agctggcgta gacgaagaac tgcttgcctt cgcccgtggg ccagaacttc   17760
cgagggaact tgagcaagat cttcgtgtac actgccatgt cgaaccggta gatcgcgatg   17820
attttccatg cttgcaggtc gatcgacata gcaaatgtca acagtatgat cgagtagtta   17880
gcagagtggt gtgttgggtg tgacatcgca agctggcaga gaccatgacg atagtctgcc   17940
tggtacactg agccgtcctc cgtcttgacg gtgactccgc tcgaggagta ggagatctct   18000
cgcaccacct tgttgagctg caggcggggg tcggcgacgt tgccggagtc gtcggtgttg   18060
aggtactggc cggcgaggta gtggacgacg gactcgtagc cccgtttgtc ggcgacgaag   18120
tagacgtcat ctccgaagtc gctgaacgtc ctctggggaa cggcgttctg caggctggtc   18180
acgcgcggcg gctcggcgta ctcgtagtca tacaggtagt agtctaccac catgtaatta   18240
gcgatcccgc ctccactatt ctcctctcgc agaaacccat cgctccccct cccagcacg   18300
catccgtccc cggcgccccc atcccctcct cctcgggccg ccgctcccc  atcccgcctc   18360
ctcgccacgc cgtctcctcc cccaccaca  aacaacacgc cgcctcgcct gccatcccg   18420
tccaacccac gccgtcgtcc cgtcgccgcc acatcgtcgt cgtgcgttat cccgccggcc   18480
actcgccgcc tccccatccc gctaaacccg cgccgccttc tccggccgtc atcatcccgc   18540
cgccgccaca tcatcgccgt gcccgatccc gccagccact cgcccgtcgcc gccacccgtc   18600
gctcctcctt ttgctggtga caatcccacc ttcggcacca cggatccct  ctccaccgcg   18660
ccgccatgga tcctgcatct tccgctatcc ataagaaact agctagtagc tgattgacgg   18720
gcagctgagg cttgaactgt atgagatcgc tctgcaggct tcctaggctc gtggacacga   18780
tcacgtagtc cgcgctgtac gacgagttgt cctctgtgct cacgaccacg cctctccggc   18840
tgtacgagat ctcccgcacc acctgcagca ttgttcaaat ttatccaaaa aaatattaaa   18900
gatgtggttt ctttcgatcac tcctacagta ctatgttcgt atggagataa attaattcat   18960
caggtttcaa ttattccagt atatgaatga attctggaaa gatagtgtgt ataggcatat   19020
aggatgaatg tgcgggcaga attcatcatg aaaaaggcgt ggtcaatagg gaaaatgagc   19080
atactggaat tgagcagggc ccattatttc gactcgaaac taaaatgaaa atgttccgat   19140
ttccatttgc agtatgcatg agatgagctg gacgaaatat actctaatta ttgtgctaca   19200
taaatttatc tgtgtagcac ctttattgca tgtatatctc aactgcccac gtcgagttca   19260
acaacactgt acagtgggca tccccgttga agaaagtgcc tcgagataac ttgtacttta   19320
tgtccggtga aaacccatga tctaactttg gtgtttacac tgtcgaaga  tggcgcttgt   19380
acactactcc tttcctagat gtgccgttgt tggtggacct ctttcgccag cttcgtcgtgt  19440
gattatttt  aaataatacc atttttaat  cattttcagg aataatgcgt ggttcaaaa   19500
aaaaaaatc  aatcggcgga cggcaggccg accgcaggtc tcagagggtc ctgaagattg   19560
gaacccggtc ggcggacagg ctgccgatca gccagccagc ttccgatcgg caagcacgtt   19620
gccgacgagg tgagctcgtg gcagtacatc agtccatagc ctccttcttt cttattttc    19680
cctggtggcg gggcgtcctg atctctcctg attgatgtgt gcacatgcta agatgagacc   19740
tggtcggtaa ctattccatc ctcatgcacc aagcgatgtc tgcacgcact gagaagagac   19800
gtggggcaag gaaaagtgct cagcatgcaa ggaaaactgc tcatatgcat tgtagttct    19860
tgattttgca tgaggccag  gctagtcagt ttccgctgag cagacaaggt ctaatcgcg    19920
tggcctggca tttgttcagg ccgatcaggt ggttagtttc acttcgaccg atcggcacgc   19980
gctgaaaacc gatcggtcga aagatgccg  acgaagtcag aaaattgaaa ttttagaaa    20040
acgcgtatta ttcctgaaaa tgatttagaaa attcgtatta tttttaaaaa tcgcccagct  20100
tggtgttgcc aatgcgggtg gttgaccgct ttggcagagc catgcttttt gtgtgcaaca   20160
ttcgcatctc aactaggtct gaatattacg atggtatctt tttgatatta gtatattttc   20220
tttattaaaa atatacgtac aaatgacata taataagaag attaattttc attagcttca   20280
ttagcatgtg tttgcccgg  tgatggacta tagtaatctt gtttagaaac cggttatac    20340
acaaacgatt gcaatgcaat tcatcaaatt tcacaatttc agttgcatga attttagaag   20400
aatttacata atacattata aaacagcgcg tatccaacaa gagaaataag ccatcgtgcc   20460
cacatagttg gtctttagta gtgagtctat ctgtttggtc gtagcgtgtg ggttcgagta   20520
tgcatctaca ttataatagg tgtctcacaa aaaacttagt tttgtcttat caaaaatcag   20580
tttattagtt ttacatattt tatttttat atatacccac tatgctcata actcgatggc   20640
gcttagatat tatccgtctc cagtacaaca tcttgaccat tagttttttgt aagcacatcc   20700
taaaaccatg gaaatttaaa atataaaaga atattattc  tcacaagaga tcttagcgta   20760
ctatttatac tttgcaaaat taattaattt ctcggttttc ctgattctcg gctcagactc   20820
gtagatctta ggattgaatc gtgattgta  atagctatga gttgcatatg attgaaact    20880
aagattttat tcagctacag atgggattgt agctgagaaa aatgccttgg gcagttcgat   20940
ttctttatga ctcgtgcaag ttagggttgc aattgagaaa aatgcaccaa acccgttggat  21000
```

FIG. 11 (cont)

```
tgtttcgtga ctcttgcaat tcaccagttg caattacaat tgataaaaaa tgtctcacga    21060
tgagaatttc actccettaa ttttgtattt tttggtaatt caagctagaa aattcatgca    21120
attttgacca tctcctcacc acaagtttgt ttatattatt aattattagt atataaaatt    21180
ttaaaatgtt tttctcttcg gggaaaatta gtaaagtttt aggcttttcc gaaaatcagg    21240
tggagtacct tgttgagttt taacctagga tctacgatgt tcccggcgtt gtccgtgctc    21300
aggtactgtc cggcgatgtg atacacgagg gtctcgaatc cccgctggtc ggcgacgaag    21360
tgcgcgtcct ccccgaagtc ggccaacgtg gcggtgggct cagtattctg caggctggtg    21420
gcaccggcg gctcggcgaa ctcctagtcg tacctgaagt agtccagcgc catgtccacc     21480
ggcgtcgccg gcccgttcgg ctggctgcaa aaaacagaa gaggtctctc atggacatgg     21540
tcaactgatc gatgagtata taactgtata tacaggctaa gaagacgcac gtactggttg    21600
aatatgcgct gcatggccaa gatggagatg tcgtcgcggc cgctgggatc catctccgcg    21660
gcgacttgc cgcccagctc ttccacttcg tccccacggt ccatttttctt ctgcaccgtac   21720
tcctcctcgt acaggccgcc gctcgttctc gtcaacaata gtacaaagca tgagattagg    21780
tttaacatgg atgctgttgg aacaaatctt gttattagta ctaagtttac agtttcagca    21840
tgtttcattt tgatttttgtt gaagtctgca tgtagtagtc gtctcagggt aggactgttt   21900
atgcatgtca tcatggtgaa gtgcacggat cgatcggcaa tgttgcgagc tgatcgcgg    21960
tcaagagaaa ccactagttg cgactacatg ttgtattcag tcaagtccta cactagtttg    22020
agtccaccgt cagtgcatgt agctaaggat ctatacgttg ggcgagccga gagactagcg    22080
ctatatgagc tcagttagtt gtggcataa cgtgatgttg atccatagac tggctgcatg    22140
cgcgtgtggg cagttagtgt tagtggtcta ctagttagtt ggcacaagtc ctgaacgtgc    22200
gtgcctgcag taagtgtgga gtacaagtcg gatcaaactg gtgtgtggct gaccgtgtg    22260
tgcgtgggtt atgttataaa agcattgtaa cctcagttgt ttcagtccgag agaaatacag    22320
agaaagaggc acacgtgtgt tgccgagaat acctgtgtgt tcttctccac catatatgta    22380
tgtgtgttgt atcttgggca attctgtcag atgcaacgct tcgttcatca tcagtcctac    22440
aacgatcgtt ttcgatggag taattagaac cacgacgtca aagatccggc gtcattacat    22500
taatttctga taatttttaa acttctcgtt cacgtcatca gtatatgact ctgtctgtag    22560
ttaaltggа cccLcL_LLL aatalcglcc aalca_taga ccacaltlcl gcgcglccgl     22620
gtcatttcca cgtggttggg gcacgtgcg ttgctgttca tcaatcatca gttattatta     22680
ggtgcggtaa tatcgacagt taccggccca tcagctaaat cttttgtttt cgttctcagc    22740
acgtgcatat atgttcatct gtttgggcat gcaggcatgc ctgtctaatg tctatgcata    22800
ttctagataa tcagttttttt cttcgaaagg tcttaatcgt cagtttggca gcatagatgt    22860
cttatatata cagtgaacgc acgtacttct ccttgtagac gctgctgacc acgccgtcga    22920
agtccgagta gaagttcctg agcttcagcg tggagttcac catgggccag atcgggttga    22980
tcttgtcccc gttgacgccc tccacccagt tggcgcgat ctccacgttg acgccgctga    23040
agttctgctt gtgcatccgc ccgccgatgc cgtccgtcgc ctccaggatc agcaggtccc    23100
tcacgccggc gtcccacagc cgcttccccg ccgagatccc tgcaggcaaa gatgtacaac    23160
accgacgaca tttcatgtga cgtctatggg tagcaaagac gtttccacca aggatgcgt    23220
gcatgctgat taggtaccgg acatgccggc gccgactatg atgaccctgg ggcctctgcc    23280
ggcgccgaga gaggcatgct gtgcagctca cagtattcaac actgctgcta tagcagtgac    23340
aaagcaagaa ggtttcatct ttcttctcac actaattctct ctggccttgc cgcgaatagc    23400
tagtttgctc ccgatggacac tatctggtta agctgcgcat ctgctctccg gccgagccag    23460
tcagtqtgca cttatataqq gccagagagc agatggctac acaaaaccac tatgaattaa    23520
agacgcggga accacacacg ttccatatag agttaatacg attgcgacga aatcgaatgg    23580
tagctagaca ccgtggatgg aggacgatgg tggcgccgat cttatcacat ttgttggctt    23640
cgccaaggtg ttttgaggcg tttctctggg atgagatatt gcgatctaat cttgtagtat    23700
aagttaacca gatttgctaa ctcccagtcg actgagaata atccttgtta acatgaaaac    23760
cgttggattt tacgccaaga tatctgcgtg cggattgcgg aatcatgcgt gacgttctga    23820
ttgtcgaaat atgatgcttg cgttgttcgg cattctcact ttgttttgtt ttctgtttgc    23880
cccgtcaatg tcagtactga gtactgcaga tgggtcttca ccgcggatt cggtattttt    23940
gattcttttt cttcttatgc tcattttttc cataaagggg gatatactaa taccgcgaag    24000
ataccaatta caccccagcat ctgcgacaac gtagtgctct aatagccaata cggatgcaca   24060
caccccaaaaa aagaaagatg aattacagaa aagaaaagtc tcgcttcagt gaccaattcc    24120
ttgcagtagc ggacgaacca ccaccagaat agcaccagaa atcatcaac tccaaagcg     24180
atgccttcaa ggaaacattg cacaagcgtc gacatcgccc taatcaaaga ccatagctt     24240
tcaccacgga gaaagtccgc actcccaaaa caatgccttt tcaacaagga cattgccatg    24300
cacaaccaat taaggccaga ccttggattt tcaccctgca agtttataca ctgaatttct    24360
cttgtgttgt tgccctcact tgctaattcc gctgcgaat tcacgaatca cgaagccaga    24420
ctcactgcac caccaggact tagaactcca ttgccaatcc ccagttctcg gcttccatgc    24480
cattatccgc gtgtcagttt cccatggaac caacatgtcc catgatggca acagaccgca    24540
```

FIG. 11 (cont)

```
gagcttcgca acgcctcttc tgaaaccaaa cggtcagaat aaaacatggt tacacgcgat     24600
agaaatggca tgaaactctg gcaaactcca ggcatggcgt ccatttggaa tacgccggcg     24660
gattcgtatg gaactcagca tgcagcccta gatccaagac agctagtgac aacaaaatct     24720
tcatcacggt gagagagaag accaaggacc gccaccttta tttaatactg cgccggcagc     24780
ccccacgcca ccagctagcg gctaagaaga aaacaaatcc tagatgcgaa aacatgggcc     24840
gacatccgca tagcaggtag gcaccacgca acaccgaggt agggcaagat cgcttccaga     24900
atggcccacc ccgcctccag tgccatgccg ccgccaactc aatgccgcgc caccgccggc     24960
catcgctgcc catgcctgcc ccacctccat ccgctcctcc acgacacgtc catcgcccac     25020
caaagtcgta ccctgccgct cgcggagatc aatcgggaaa gccctctcat gcccttcgcc     25080
ttcagcagga cgggtgtcat caccactgcc agcggaggca gcggcctggg agggccagag     25140
atgggggggct aggcggcggc tggagacctc cgggatcgcc cgagcggagg cggcccggga     25200
ggttagaatt atgttgtgtg ttctgtctcg tttcgttaac ttttgtcgaa tgccctgaaa     25260
ggagacatac attctcatgc atctctctct ctctctttct atctatctct ccctccctct     25320
ctctctctct ctctcttatt ttgcacgttg ctaatatccg tcgatctatt tataatcctt     25380
aacaactaca atcattcgag caaaccaaga taggcataac acaagatata tgagttttag     25440
gagtagattt cattcatttt ccttgaaaat ctaaaaatca tccaatagat atcaatacgc     25500
ctctaatacc aatacaagat ggtaatagat atgaatatag acaattaatt caaccatcac     25560
atagagatgg acaaagatgg ccagagttca ccatcaccac ctaattagag ttattaaaag     25620
ccattgttca tgaatagata gaataaagtt caaattaaga cactacaaga aaacgggcct     25680
ttaggctcgg gacggcctct agtcccggtt gcccaaccaa gactgcggaa tcgggactat     25740
atatcatggg ggagtttgct ctatgtattc aacttctttg ttacttaaat tattatata      25800
aactctctca aagagattat catcaattac caaatggcg gagaatgaaa gtgcatagag      25860
tctccatgtg tggttttggt aattaatgac aatccctatg gaataatgtt tgcattgagt     25920
cataattgta ggagttgtcc ataggaaatg cttcgaccat atgttggctt caacgttgca     25980
ataagaagaa ataaaatgaa agttcaagat gacccaactc gaagagatca tatgcttgaa     26040
gcttgccttt catatggtga tcatggatat gtgaaaatat gccgaagaac aagctctccc     26100
atagtggagt atggggagc aattaagaat acttcatcaa gccagcacaa tcaagaaagg      26160
tgttccatct tgttgcggtc aagatcatca tcatcgagct caagtggaat gtgcaagctt     26220
aaggttatat ctttataggg tttatttctt accggtctcg tggtttagtt gggacaccgg     26280
gttataggtt agttgccgca ctatcaaggg gctctctagt gagtaacttg atcgtatcgt     26340
tcggagagag ttcaaacctt tgcatcctg cataatcttt cttggttgtt atttggatct     26400
tatccatatg gtgttttaga gcttgtactt attctcatca caatccctac ttcatcgaaa     26460
acacattcca catgaaatac ttgttgtgtt ttccatattg gagttttttcc cggttttttcg    26520
ttttgagagg tttcacctct aaatgcatga aaaatctacc ccacttattc tttatatttt     26580
cactctttgt ggggtatctc gtgtcatcct atttacaact aaattgcttt tacctaaatc     26640
tgagttttct aactcaagtt gttgcaattt ccttattaga gctgttagcg gtttagctct     26700
tatagatagg ttaaaacttc cccatttga tcttatacac cgtagatgga ctatgatttt      26760
tcccttacatg atcttgtaga tatttttcgtt gtgattccaa ttagcccgag atcatcaaat    26820
ttggagtcca gatgtgaaaa tgacgacgtt tttcgtgtgc ggtacgctgc cagccgaagc     26880
ggtccggccc ccggtccgac gaaacggtcc cggctctcag attagtcgcc ggaatggcgc     26940
tgggccggc cggacaagtc cggctgacca gaatggtccg gctaggcctg gaacgtccgg       27000
ccgggtgcga aaatggagcc ctttctccca aaccgctact gctcctcctc ccatataaaa     27060
aggggccttc ttccccattg agcggctgct tcttctactc tctctctact ccattgttga     27120
ccttgagaag cttcctctcc ctataatccc tccatgattc ttgctcatat ttaagggaaa     27180
gatagaggag atctagatct acatcttgac caaataaatt cctctctttg tgacggaatc     27240
cactagatct agatcttgga gaaatttggt gtacctcctc ctattgttc ttcctctctt       27300
attacccaa tatcttttgt agctttgttg gaatttgata gagaatgact tgagcatctt       27360
tgtggtgttc tagacgttgc atttggtgca tcggtttgac ttctccacgg tgatacgtga     27420
aggtgaaagt tcgtgagaca tacacttcgg gagcttgttc ccggagcttc ttcctcttgg     27480
gtctttgaac catagacggc ttagtggtct ttgtggtgtt cttgggggcct ccaattaagt    27540
agctttgtgc tttggggctt agtggtattc ttgggggcctc caattaagtt gtgcagattc     27600
ctcaagggca aggcctttgt ggcaatttat tggcagcctc caattaagtt gtgcagatag      27660
ccccaagctg tgtgcggtt cggtgaccac cctaaggttc catagtggat cgaggacatc       27720
cctttggtg ggaattctct agaagaatac ggtcgccctc gtgcatttgg agtgacttgt       27780
cctccacacc gctccaacgg agagtagcac tcgcaaaagt gtgaacttca ggatacatcg     27840
ttgtctccgc ctcacttcgg ttattcctat acccgagctc tttacttatc cattttactt     27900
tgtgatagcc ttagtgattg aagttatata tcttgctatc acatagttgc ttgaattgct     27960
tagcataagt cgttagtgca tataggtgaa tcctagttat ataggttttc tgcttgacaa     28020
attaaacgct agttttattc cgcatttgtt aagctatatt cctaaaagtt ttaaaccgca     28080
```

```
tattaacccc ccctctaggc ggcatccgtg tccttrcagg tgcaccctaa ttacatgcat    28140
gttagaacga ccttgtctcc atgttcttgg cattcrcttc aagartgccc tttttgatat    28200
tttattggtt tcaatgatg atccacctaa cgtctccgct ccaactcacg gaatacagag    28260
tggtgatgat gcaattttct ctctcraatg ctaacacaaa catcaaaggt tggacccaca    28320
cgaatcttgt agcaactcat cttgtggcag atcatgcatg cacagctacc ctactagaca    28380
ggacacaatt ttcgatatat atatatatat attatatata tatgcatgct tgttcataag    28440
agaaattata ttatatatgc atcagcgttt acaatatgta gtagcgtaga gtccgtatac    28500
gaaaatttgt ttgaaatgaa aaataattgg agcacaaaat gcaaacacaa aataaagggg    28560
ctaaaaccct aaaccctagc gcttccttta gtcccggtta aagttaccaa acggtactaa    28620
aggttctcta ccccgagcgt gcttcacaca cgattrattt aaactgagcc gttttctcta    28680
cgtctgcacc tacataaggt tacatcgcac acaattcatc tttgaagaag agttcataat    28740
atatttggtc ttagaacgga ggcaaaccaa ttaatgaaac atgggttccc ttccttttac    28800
aaaagaccat caataatatt tgccattga tcggaagagc atcaatcaaa tatgattgcc     28860
cttcctgtta caaaaaggtc ggccttaact tcacattaca tacatatata gggcctaata    28920
aagttggtaa taactatgtc atgtactaca catcctcctc ggcaccagag gacacgcgta    28980
gatcgcgctg gtgtctgatg catctccatc gtcaaaggct acgccctctc cggagcatga    29040
tgccacggtg tcgttggcgc aatcgccact agtgcctgat gattctgctt cgaaggcagc    29100
catcgccttt tccagcgcgt tcatccacaa ctcagcaagc tcgtcggcgg gaaattacag    29160
aacacgcact gcgcggccgg cctlcrtaca tttctrctta gcgcgtagcc aagctgcagc    29220
cggtcctcgc ggagagtctc gaacgagtca tccaccacgc tatgcatagc ttcttcctca    29280
cgccacgtca actcgatgga ctactcgagc accatcttct cctcraagtc ctcctcaatc    29340
ctgcctagat aatcctcgtc tgcagcgtgc ttctcctact ctagagggtg atcctcctcc    29400
gagtcatgcc ccgtgaggtc gatgargctt cccccagcac tgatgtgttg tggaggaatg    29460
ctcgtcctcc gcatctgacg gtgcaaggtc gatgcaacct acagrggatt ggtagggagg    29520
catcgtgcaa aggtgggtag gctgccagag agaagagtga gcgacgcatt tataggcgag    29580
gagctaaaca aggcgaacat tttgarrttg catttcaaac aaaatcagtt aacttgcgag    29640
aacattrgat gaccaaaata tccgcaaacg attrcgcgga caaaaactat ttgcacagta    29700
tagctgacaa cgtttgcgat accttcctcc gcatacaatt ctatttgaac aaattgtttc    29760
tgatatttta tcgtgcacgt atttggcagc cacatcattg cagcccatct ccgcgcgctc    29820
tttcatgtcc ttgaaattca tttcactttc ttcgttgtct tgttgttag tcagttggac     29880
ggactggtca tgctcctcct cggccatcag aggggcttgg ctctaaacgg cgacgttgtg    29940
cctcgggtac ggcgcgacgc aacataggcg agcggrcttc ttggrgcgaa ccattacaaa    30000
gtaaactaca tgtgtaccgt aatcgrgggg tgtgccaaac attgcggcgg tgtgggggg     30060
gggtctgtag cccggccaag gatccagctt gtcggcgatg tgtggcacgc cggaggaagg    30120
cgtagaagcc agtcgtcgac tgaaaattag acacacgact tttacatact gtaccatttg    30180
agtccggcag aggagaagag accgtcaaga tttaaaactc ttcgcaaaat attcactatt    30240
cacacacgat aactttaccc atactcgcgt gggatgaagg ccctattcgc tgaccattat    30300
ttttaaatag cccgtttgtg gactcrtcct gactgcccgg aaataacttc cgtgtgctttt   30360
catgcattcg tataggcctg cctggagacc aagcacacgg ttcgrggttt atggcgtcat    30420
cgttcggccg cacaatacac aaaaaggtct ttctargtgc cactgagtcc ttaataggcc    30480
tgatctgtac tagtgatgcc ctcacatttt taaacgccga gctargcccg caatagctgt    30540
gctcgcacta gccggcaaa acaaatccac cacggaaaac tacgrtggaa aactgtaggc     30600
cctattttt tcacacgaca tatccctatc cactacgcac gagacgacta aaactcctcg    30660
gtacattaac aaacaatatt tttttrtgtc atgcaragat aaggrggggc gcatttcccc    30720
ccgtgtttcg tgcacctgtt ttcgaragaa aagttaatcg caatrcagta taaatatcag    30780
ttcatccatt ctgtttaaat tataatttcc atgtcattaa gattgataac tatatttcat    30840
tacataatat tagagtgcta ttgttrgact taatcaacat ctaactacct aattaacact    30900
aattagggaa aaaactccta tttctagttc tccatcaccg ctaarctctg gttgccttac    30960
accatgacct cgccgccata cgccargacc tcgccggcga tcccatggac cttttgggagt   31020
tgttttttcca gccatattta tgtagggtct gaaatgaaga gaatcatgat tttagaagaa    31080
aatcaagagg gagtgtgaaa taaagraagg gccraatggt agtgatttag tgcgatgtga    31140
ggtcgggatt atgaacattt accgrgtgg atttagcatg tccggcaaac agagagaggg     31200
agtgcatgag atctagggtt cccagrtgag tgtggagtgc ttgagatcta ggttcatag    31260
ttgaacgggg attgcgtgag atctagggtt catagrtgag ccgggagatc gtgatatcta    31320
aggttccttg ttgagtgtgg ggactgcatg agtctagcgt tcatatttga gtgggggagt    31380
gcgatggtat catgggttgt tgccartgac catagctaaa gcatcactcg caatgttttg    31440
ggacgatta atcttaaaga taatacacag tcgaacgtc cgcaaagtg ccttgatcta      31500
ggcaacaagg tgacccggag aacaacagtc cattgcagaa cttgrcacaa gccgcggcac    31560
atcagcacta cctgtttcaa tggtgattga gtcttggctc cattgcaagg caaagggcta   31620
```

FIG. 11 (cont)

```
tgccctccat acactcacac agctcagctt ctagagctaa ctagcagtgc tgcaaggccc   31680
cgcatgcaga gaagatgatg tttcctcaga atctcctaag atcttacctt tcccagttgc   31740
gctcgtctgc tccagaaagg agccatccac actgagtgac ataggcatcc ccaatgggcc   31800
taccgaagat ggtacccggg gtttacagaa ggcccacaag tcgaagaata tgaagttcgg   31860
aagcccagtt agtattaagg aaagttagag ttgtattagg aaatatagag acttgtaatt   31920
ttacgggacg ggttagaaac cctcccggac tctgtaactt gtgtattacg aatccctcgg   31980
ctccgcctcc tatataaggg ggagtcgagg gacaaagaga ggatcgaatc cattgtcaac   32040
ataaccctag ttttataatc gtccagtact tttcggctaa aaccctcgag atctacttgc   32100
cctctacttc caacgaaacc ctagtctaca atacgtagac attgataagt taataccttg   32160
tcaattggca ccgaccgtgg ggattagagg agacaaggag ctgatctcga tggcacgttc   32220
aagatcgtcg acttcgtcgg tagcaagcaa cgcattggat ccaggtaaat ggatcgaaac   32280
tgatctagtt gattttgttc ctcacccgcc ctcccgtttg gatgcatatg cgtatctgga   32340
ggacccatg gagatgacgt tccgaaagtt ccgattctat gtcgagaaag aaggatcgta   32400
tcgtctcgaa gttccgatct cgtcgggatt atcggcggtc gattccgact tttcgtcagg   32460
cgaagaggag attttgtcgc cacgcttcat caacaccgtg gcaagcgaaa agctcgccaa   32520
gatcttcagc gacatgtcct tcgagtcgtc tgcggactct gatataagca gtgactcaga   32580
cagcgtcgac agcttcaatt tcatcgacag atctattgtt attgaaaggt cttcaccaat   32640
ctatacgatg gtgtcaccaa tcctgacaaa aatcaaaatt caaaatatca tcagatctac   32700
gcaattgagg aaaaaaaccg agcagagtcg gaaacatcag acgcttcga cgatgtggga   32760
aatccatatg tcgatcccgc tgatccaacg cgaggtctag gcactaaata tgttgggcct   32820
acaccacgtc taagggttca gctcccgcaa gaagcgtagg acagagccgc aagagccatg   32880
gatcgtacag aaccaatgac cacaactgct acgtagaag aattgcaagc ttatcaatac   32940
agacttgctc gtgttagcag agagttagaa aaacagacag ccgcattaaa tagaagaaag   33000
gaggcagctt ccgcgtcaag caggcgaagg gcagatttaa gtcgacaatc aggaaattcg   33060
ggacatagtg atacgtctca aacgtatcca taattcctta tcttccatgc tagtttatg   33120
acaatactca catatttat acacacttta catcaattat acgcattttc cggcactaac   33180
ctattaacga gatgccgaag cgccagttcc tgttttgtgt tcttttggt ttcagaaatc   33240
ctacacagga aatattctcg gaattggacg aaattaacgc ccagggtctt attttccac   33300
ggagcttcca gaagaccgaa ggggatacga agtggggcca cgaggtggcg acaccacaag   33360
gcgcgcgcgc caagqaggggg cccgtgctac cctatggtgt gcgcccctcg agcgccccc   33420
gactctgccc ttccgc                                                 33436
```

FIG. 11 (cont)

```
gatgccgagt accaagctgg ggtttgttga gttcttccag aagtgcgtgc ctgcctgcct    60
ctcgtttgtg cgtrcttgat cttgaccaca ttctgctggg tcctggacag tcaagtagaa   120
acaatgggac ccgcgtctac accgcggca gcggcactcg atgacgtgac tttagacaac   180
accgacgccc tcgactgccg cctttgctgc ctaccactca agccgcccat cttccaggta   240
attaacatat gcaaaatgat gtcaaccatg cgaacaaggg ctcatcgtct catgtctccg   300
cgcttgcagt gtaaggtggg gcacgtggta tgctcgacgt gccgagacaa gctggggcg   360
gctcggaggt gccatgtgtg tcccacggcg acttccggcg gataccaccg gaaccacgac   420
atggagaagc tgctggagtc catccgggtg ccttgctcca acgccgccta cggctgcgcc   480
gccaagccgg tctactatga cacggacacc cacctccggt tgttctgcca gcacgcgccc   540
tgccactgca atatagaagc atgtggcttc gttggctcga cattatcggc gctccttgac   600
cacgtcttcg ccgtgcatgt tgaataaacc ttatgcatca gttagttcac tttacagtta   660
tagctgtagt taggcatctg ttagtcgtgg tgtttgagcc agtcatggga tggcatgaca   720
tgcggatcaa daccgttgta ataggtgcct gtagatcacg ttcggcacga tcgtctcgtg   780
ggatcgcgcg actgtggttg ctcgtcgcgt ggagcgtttt tagctgagat tgttacacct   840
ctgtatctct gaataaatag agaaaaaaaa ccgaaaatgc agtaagtttt acactgcgcc   900
aaactgtgtc tcccctgtgt gttttttatcc acttgtattt gttcttcacg tgttcttcgc   960
gagatcgtgc gagagagtct tgctataccc gaggatcagg acaacagttg gtatcagagc  1020
ccgtgtgctc gatcgctgag gcaatgtccg aatccccgac gaagaagtcc ggcgaggcga  1080
cgccgcgcgc caagatctcc gatggctcgg aggaaggtgg aggccagatc gtgatccagt  1140
ggatggttag ggacggtgga tcggccaagt ggccgatgct caccagaacc aactatgccg  1200
actgggcact actgatgc                                                1218
```

FIG. 13

```
aacggttgta tcaagagatg ggatgtcctc atcactttc ctacctcact agcgataaag         60
tgaatgcatg tgctatgttc gtcacgtgat aaaagtgatg atcttgtttg gtcaaggtag        120
catatttgat attcaaacat tatgtcaaag tacatatgga tatactttgt taattcttta        180
tacacaattg catggagttt tccctttctt gtggagtata agagagatat gttgcatcat        240
ctctatgtta ggacgtgatg cccatatgaa tgcgtatctt actcttttt ttcgcatcct         300
catatcttat tggtgaatta ctatttgtcc actaaaactt aaagagaga atattcaagt         360
gaactcatga accccggtcc acttttatc ataagaaaaa tcttataat gcttttatct          420
tatttttctat tttctgcact attttaatcc aaaantacaa aaatatttat ttttcttatt       480
tgcatccaaa acaccaaaaa taatcaaccc cttacattt ttacttaatt acttatttc          540
atctagtttt actcgcttta tttttacttg tgttttattt tcttacgcga aaccttgtgc        600
ttgataacca tgcagtgaag ttagggacac aaggctttta ttttacttgc aggattgcta        660
gaagaagaga gaagagaata atctttgctc agtttcccga gagttcgatt taaaccctcg        720
aatcaccctt ttggggaaaa tacttagctg acacaacact ctacacttgg aatcccaacg        780
tatcaagatc tttttagcgt ttttttttg acactcaaga ccgtgaggca aaaatcccca        840
caataattta ttactccaaa ttatgccaac ttatatacac aaaagcaaat atgtacaaaa        900
gctagagaaa gataaaaaag aataagggctc taaggcagag acctaatcca agacagcaac      960
ctatccttat gcttaactttt gatcctatac tgcatccaag aaatctttttt ggcgttgttg    1020
caggggagta atcaagacac ttaatcaagc ccatcgacta ttatcacttt cttaattttg      1080
tatcttcagt ctatttgcat tcatgttgca ttgacactttt tatatatgca tgattgccta    1140
ttagagttag ctttggaata ttncaaaagg tagaatgat catgatgaa atcatgtctt        1200
gcatatcttg gttaaaaatt tctctgcgta tttagatgct gggctaatgt ttgaggtcct      1260
tagtggattt tcggagaaga atgagtggtt ttgaagtta cagagagttt agccggcacc      1320
agtacgggag catctacccg taccacctgc ctgtaccgct cctacaatgc aacgaagaaa     1380
ctaattttt tccagaaaac tcactgtgag gatagcacc gtcggtacgg cgggatgcgc        1440
ccgtaccaac ctcgccacca gacgcagaaa attgaagaa tttccagaga aaatagtgat      1500
cgtcagtacg agcgcgttag taacaagcag tccgccgaga cgctcccaa aaaccttatc      1560
gcccgcctcc cggtgcagga tctcaacaga cagggttta gaggcctact ctcctggacg      1620
gtcgtgcaca cagtcaccg gatgaggaag gctagagagt agcacacaa aataaacttc      1680
ttgagagaga gacaaacaaa gcagagagtt aagcatcaga tccgttctgt ctcctggccg    1740
gtataggctg ggaggagagc cgaccgaacc cgtaggaagt cgttgcacac catggacacg     1800
aggcgagcat gcagatccgt tctgtcttct ggtatagctt gggaggagag ccgaccgacc     1860
gcatggctgg cgagcatgca cacgcatgat cgacatgtaa ccaagcaaaa aatttaggct    1920
tccacagaag gtgtgtcaaa ctcaaactcg agtcacgaaa cgtgacacgc gtgcgatccg    1980
tggcgagacg ggtgacagaa gaggaggagg agtgcgcgag agctccttct cttgtcactc    2040
acttgaaagg actagaagag cagcccttat aaaccatncc aactctaaca atgtgggact    2100
aaactttgtc ccaaagacta tctcaaagct accaacttga tggagcttga gatttcagaa    2160
attgtaggca atatggacta tcttagtgga ctgtagccca tctacatcca acaccttttt    2220
tttttcagat caccgacct gattaataaa gctcctttt acccgaaaaa atccagcgg       2280
tttctttacg tttacganca gntnaaaang aaacagaaan tccgaaacaa atttagacaa   2340
aacaattggg tccttcgtct ccgcttcgac gcctgctccg gagggttgag cgaaaatcat    2400
gaagcgtcga atggttggtg caaagcgttt tccagcagt gctggggcgt atccgatcat    2460
tccacgtgcc tgtcatctgc tcgcgtctt tcctgatttt cctccctcg ctcgcactcc     2520
tcccaggccc tcgccgcctc acctcagggc ccactccatc tttgccgcca ccctcgccct    2580
ctttacgcct gacgcgtctc gcgttacttg acctcggatt cgcctattca ccagatgcgt    2640
cctgttgttc tctgatccca tctaggaaat cttcctgctc gagcgatagg tccgtacttc    2700
gctctctatc tctctaattg ccaaaatgat ttcgtgatgt ttggtgtcgt attcctttgt    2760
tccaacttga ctgaaccttc acatttcttt ttcgcttttt gagataggag ctatccaagt    2820
ttcccatggt tagtgccgag tttttgtgaa cgactgtgcc gaaagttctg tactgaaaat    2880
caaccagatt atctttattt tccgcatgtc tcagtggaag ctattctagt tttgattaag    2940
gacagtttat caaatgaaa gctagcattt taaagcaaaa tggcaatcca tatcttgagc    3000
taaatgtcta cagactacag taccagtcga ttcaggaca attttctctg ttggaaacgt     3060
cggcatatag aaaaaccata tcatagacac tatttcacta tttttaaaac agtaaccacc    3120
gaggtttctt cagtttagcg aacaaacaat tccctgtaat agtttgaaat aataccaatc    3180
gcaaaagata aatttctcaa accatcagtt catagtgcat tctggttcat tctcgaattt    3240
ttttagtgca ttctggttga ataatgctca tttgccttta agagtaacgt atgaacacta    3300
gtattactag aataatacta gtacgttacc tgaacttgca ctacgaatct ttcttgtctt    3360
tatcgaacta ggagagttat ccttcctctt acgctgtatt gcttggcata ctccataaat    3420
tccctttata ggctaataac tggcatgttt ataggcaagg atgtctcaaa ttcgtaagga    3480
tacaaagaaa acagtggaca tgaatgcgct ggcgagctcc atgaggtgtg aacttgatta    3540
```

FIG. 15

```
ttactggtca ctggctgaag tctctgacaa tgggggagtt tcatgtgtca tctacaaagt    3600
ccaagaacac attcgcatgg ctgacaagct ctcttacgaa ccttgtgtgc tatcaattgg    3660
cccttatcat catggagctc cagccctaca gaccttgcag aaagacaaat ggagctattt    3720
agattttatt ctgaacttga atacagataa aaccttgcag gattacctac ttgcacttga    3780
aagcctatca aaggtagcaa ggagctgcta ctcggaggat atcgaaatgg acgctgagga    3840
gttcctgcaa atgcttttac tcgatgggtg ctttgtttta gtagctcttg gaggaaccaa    3900
agaaattttg gcagccgcaa aacatataaa gttggacaaa ttgaagtctg aagatacgcc    3960
agagaacata tctaatccca acgatgcttt taatgggaca gatgaaacaa ataacgaaag    4020
tatgaaccaa gaaggtggag aagatggtaa attgcaggca gaacaccgca ctcaatacca    4080
agatgaattc gggcaatggt tctatagatt tttagttcat gatttgttct tgttagagaa    4140
ccaaatacca ttctttattg tgaagaagat attcaatgta gtcgccagtg acaacatctt    4200
ggatgattca ccgtttactc atgaaatatc gagatatgtg gacgctgctt tgcggtggtt    4260
tccaaaatca attcaagagt ctgatatgcc gaaagacttc gacaattcac ttcagctgtg    4320
ccacatgtac tttcggccaa gccgtacggc agaggattat agctatcaat taggaaagca    4380
atatttcaac agattcttaa gtttcggcct caaatacttg aaaattggac agtatcatga    4440
cgatactgaa gaatattcat catacaatct tgagatacca tacttacaag atggccagca    4500
gttgagtcgc tggcctcgag ctgcacaata ccttgaagct gcagtcaagt ttaagaaacg    4560
ggagcatgat caattgcatc ctcattcact attagacgta aaatttagca atggtacaat    4620
ggaagttcca tgtattgttc ttgatgagtt cacgggggct ctctttagga accttattgc    4680
atttgaacaa acttgtcctc agtttggaga tgactttaca gcatacattg ttttcttatc    4740
ccagctcata agtatcgctg aagatgtcac actacttgct cggagagaga tcattgtgca    4800
tcatctcgac agcgacgaaa cggtgtcaga tctgttcacc atgctcagta aggatgtggt    4860
ctttgatttt aatgctcagt attatctgaa atctttatgc cagatgatgg agacttacta    4920
ccagagtcgt ctgattaggt ggatggccatg gctttggcta aatcacttca gaaacccatg    4980
gttggttttta gctgcatttg ccacagctgt tgttctcgta tctacagtag tacagacagt    5040
ttatggagta ctggcctaca ttcacccacc aggatccaac aagtaaagta tgttaagcat    5100
ggccaaggcc aggcagccaa catatgtaac atgcgactaa ttgttggtat ttagctcttc    5160
tgtgtgccaa gcttcagcaa caatttccat atccctgctt ccgttttcct ttttcagaat    5220
gtaggagcta gtcgctacca attcacagt cgacagacag aagagcaaca attgacatgg    5280
ttatggttat ggcatgaata gcattgaata ttgatgattc actggagttt ctgaagctct    5340
agaaaaatgc agacttaaac ctacatggcc tactttcac aagatggcgc gcatctgtcg    5400
atagcaatgg atctacattt atttctcaa gttttgaacc ttggagtcat ttactacttt    5460
aatacgtgca acagcatata tgttggttt aagctctcct tgcatgacag acgacaaagc    5520
ggaaactggg ctgagctctg aataagatcg tagcatagac acgtacggag gtaccagtgg    5580
cagaaatcac ataaacgtta cagtcatgta tctcgggctc tttatgtatc tgatgtattt    5640
ttgagttctt ggcacaatat ttattgctca agaaattttg ttgttacggc ggtacacatg    5700
cttgaatcag atgtgctgat agtattgttg caaatgctga tacgtaaccg tgttttctaat    5760
aacttctgtg gtgtctactc acttatcctg aacctaatcg gatgcctcgt tggatcgaat    5820
gtcgtactga attggtgaag ttaccccctg atgccggggg aaatcctagg tccggttcac    5880
cggactaggc ggcagccccg ccaatgtatt gttatcttct tagggcatct acaatggaga    5940
cgcttatcaa cgagcgctag gattttttttc ccagtcggtc ggcagtttg acgtacgatc    6000
ccggctgcag acgcttatct accggcgtcg ctgcaaaaac ctgcgccgga cgcttccttt    6060
gattttcctt gcagcatgaa aagcagccgc ggttgttata ccaaaattag agggcagcgg    6120
ataacgcggg cgatacgatt agtcgatcaa ttcctctccg ctcaagcgtt tatgtaggcg    6180
tccggcattg aacatgccct aaagacatt gtctaggcca ttagggaggg accgatgcgg    6240
ctttcgaagt ctggccgtgg tcttgaagtc gaggtgagc tttggtgttg tcttgcttgt    6300
tttgtaacgc ggttttgaag ccatatgctt ctcttctcac cattctagta aaatgttggt    6360
caacaagagt tgtttaccat tgggtgtgtt gtttgccatt tgacgttgta ccgtggagag    6420
aagttgttgc cttcttagcg ttgtatcagc tatcttaatc tatcttctga ttgataaatg    6480
gtacagttat cactcactac agttactaca tttgcgagat cctgatcgca gattcgtgtg    6540
aacttcatgc atgatctcgt ggtgcacgcg accaccagaa tccagaaccg cctcccccga    6600
cccagatcga cccatagaca atagcatgca tctgactcca tgaccaatac catccatctc    6660
caccgccgcc acgtctgga ctctggacac caccaccca cctcactacn tcacccngcg    6720
ccgctgctg ccgctgtccc caccgcctca gccgccactc caccgccggc cctcccctct    6780
ccg<u>atg</u>acca gcccatccgc gccgcgcc tgccctcacc tccgcgcgca ccgctcacc    6840
tcgcgccgc tccgcttccc ccgccgctgc ctgcgcgtgc gtccgctcgg ccgccccgag    6900
atccgccgcg acgcgcgca ggtgcccgc tgctcccct gcgcgtcctc ctccccgccc    6960
cccgccgcc tctaccgctg cctctcctgc gcctcgtct tctgccctc gcacgccgcc    7020
tcccacgcct cctcctcccc gggccaccag atcgcggtcg acgtggaccg cgccgagctc    7080
```

```
ttctgcgccg cctgcggqga ccaqgtctac gacccggact tcgaccacgc cgtcgtcctc   7140
gcccagtcca ccgcgctcag ccccccatcc acctccaccc cctcaccgc  tccccgcaag   7200
cgccgccgcg tcgactaccg cgcctgggcg ccagatccg  ccgaatccgc gctggtcagc   7260
gcggccgccg atcccaccac ttcagcgtcc acaaccgatc cagcgggcct gcgcgggcta   7320
aacaacctcg gcaacacctg cttcatgaac tccgtgctcc aggcgctcct ccacgcgccg   7380
ccgctccgga actacttcct cggcgatcgc cacaaccgat tcctctgccc gcgccgcacg   7440
cccatgaggc accgcgcgac cgatgcggac gccaaggccg cctgcctcgc ctgcgatctc   7500
gacgagatct actcggccac cttctctggg gagcgtaccgc catacagccc cgccaagttc   7560
ctctataggt ccggatctca agctctattt gcattggttc atgtcgcgct gtcatttcag   7620
cagcctgctg ttctatttta tgctgggttc gttgcgtatt agggtagtta gccgaccctta  7680
gttaaatgcc tgtgtcaagt attgtaactg tgggcagcag gtcttgtttg agacagtata   7740
ctgtatattc tctcctgcaa aagatagtgg aactgtttaa agttagatca tacagattgc   7800
aagtgtactt agcatgatat ggaatgatgt gaacagagat atatcactaa aaggggcagg   7860
atctgcttag tgggagttgc gctactgggg gaatggttg  catgttcctg tttgaagaaa   7920
tcccattgta ctgtatatag agcatgtagt gtgaagttct tatgtttca  tttgattctg   7980
caagtactct tggcatgcct acctaaatgt tcgttggact ttgattattg atcaagtgac   8040
aaaatgcatg agcacctatt aaatcctttc aagtcagctg tttgagaggt ccatgtgaaa   8100
gtaccactag catttgctct gttcttgat  tctgttgaat ttgcctccat taactctata   8160
ttttgagtca tttattgggt aaccaatttc agtttgtgc  tacaacagta tgtcttgcta   8220
ctnccaagtt agtatgcaag tatgtagcat ctgtagtgct actcacaacg tctcttatgt   8280
ttctttgtca tggcctatca aaagtctctt ttgtctcttg ttacctactg ttcatgcatt   8340
tgctactcac aacttgcttg ttttaaaaat gtcatatgcc tattttaaaa ctgttgtcat   8400
cgtagcgaga aatagtgcag cccagacatt ttcttaagca ataatgtttta aactgcactt   8460
cattcttctg ttttatgaat ggaagtactt gatttcttc  tgattttta  tcgttatgaa   8520
ttgttagctg gtggcagcat gcaacaaacc ttgcaagcta cgagcaacag gatgcacatg   8580
aattttttat ctccatcctt gaccatattc atgaaaatat aaaggatgat gagcactaat   8640
cacatgaaca aggtagttag cttctctctt tctacttttc gaactaaaga cttgcatgta   8700
ctgcaataag ttcagatatg aactaaacag taaatgtttt gcaaaattat tcttcaggat   8760
attcagatat tgtgtatacg tcgaatgcca tgattgggca catcctttct gttcagttct   8820
tccagatcca tctcttacga gataatttgt ggctcctgaa attttgttct acttgtttgt   8880
cctactattc ttaggacagg caaacaagtg aagtgtgaaa aaataatcat cttcctgcat   8940
ttcatctttt actggtctgg gttttgatat gctgggcaat gattgaccgt gaacagttgt   9000
catttagttt acttatcttg ctcttatat  gctggactgc aatttgtctt tgcaaatatg   9060
ttctgttaat gttcttggtt ttaaccttta tttctatttt tttngnctca taataggcca   9120
cggagactgt tgcattgcac accggtgtt  ttctggtatc ctgagatcag atgtcatctg   9180
cacaaattgt cggttctcat ccacaacttt tgaaccttgc atggacttct ctttagactt   9240
ggatgctgga tgtaacggtt ctcgtggtgt tgcaaaccca aaagcacgca atggagagag   9300
gaacttagct ggcatgaatc ccaaggtatc atcaacactc atgagatgtt tggagcggtg   9360
taccagggct gagaggctag atgctgacca gaagttcttc tgtgaacgtt gcaaggagag   9420
gcaagagtcc cttaagcaaa tgtccattcg gaggcttcca ctagtttcct gctttcacat   9480
caagagattt gagcattcga cagttaagaa gatgtcaagg aaggttgatc actctttgca   9540
gttccctttt tctcttgaca tggcaccttac cctgtcatcc tcaattctca gaagcagata   9600
tgggaaccgc atatttccat cagaatccat agattcagaa gcagtttcgg aattgtcttc   9660
agaatttgaa atattgcgg  tgatcactca tagtggtaag ctagatgctg gccactacgt   9720
gacttatctc aggttaaaca atcagtggta cagatgcgat gatgcatggg taaccagagt   9780
tgacgagcat actgtcagga cttcccaagc atatatgctc ttctatgtgc agaagacact   9840
ttactataaa gcttgtgaaa agccagctgc agtctgaatg attttgaaca aatattgagg   9900
gccttattct gtaccagcag gaaatacagc catcatctga tagaacatag ttngcccag   9960
agaaaaatgc ctgctgtttt catatcattg ccagcaaggt ggacggtcaa gttttgtgtt  10020
ctcattgacc atagaatcaa tcagagttttt tttttggtg  attttcaaca gccagcaacc  10080
caaaaggaaa gatggtcaca tatatatgtt ggattgtctt gttatcctga taatggatat  10140
cttgggggcg tgaactgaaa gcactttcatt atttgacacc attggtggtg atgttctgac  10200
caatcttact cgatgtaaca ttgatttgcg caagcaaaca gtggagtatg tagaagtggg  10260
acaaaaggga acctaatttt tgatgtgttc ctggtaatt  gantgccatc tctcttggag  10320
ctagagtttt atattgctga caccgtaggg tcagtctgcc ttttgtctct ccctcatttg  10380
atttgttctt gcttgtactt catagaggaa ataaagaaat atagctgatg agatgaaata  10440
gctttttttn gcatcctttt tcttcgccg  gcggttctgt tatttttat  tgacatggct  10500
gtcagtgttt ttttgttttc cttcaactgt acattccctg gttgagtaac tgtagatacg  10560
gatcttcata gaattgctcg acgagatctt atattctttg aagtgcagta ggtgttgcag  10620
```

FIG. 15 (cont)

```
acttatttgc aagtttcaga ttagtcaggt cagtgtcttc tatatcctag ttgctgggca    10680
tgtgaaggtg cctgagtcag tgacaagctg atcacgcgtg ttgaagatcc gtcggcctgt    10740
tggctgttgt tctcaatgaa cggcatccat tcaaagatgc aagcctgtca aaattgccgt    10800
cattttcagc attgaggggt aaggttgttt ctccaggagt ctggaagaga gagcaacatg    10860
cggattcctt tatatccgct ttactgggaa gaacacctgt aactgaaagg aaaaggctca    10920
ggatcagatc cgatcaattc ctatgggcta tgagttgtga cgataagatc ctgaaaacaa    10980
aaaggaaaca ctttttttt gtncaaaaaa aaangggaac acaaagtggc gatgcattat     11040
tagcttatca ggtacttgca agattatcta atcgagtttc tgtgcttatt tgacctgata    11100
ataatttaac tacgaagcgt gagggaatga tcaaatggcg acccttttct gaaactggaa    11160
ggaacagata acacactgta cgcgtgccac tttccaccac acctcgctg gtctgcccgc    11220
gtgcagtggc cagtagctac tgtgctaagt ttgcttacca agctttcgta catttttctgg   11280
acaaaatgcg tacctgaacc ggggccagcc tatcagcatc ggctccagca attgcaagtt    11340
gcttccagaa tgaaaagttt tgcccagatc tcaccccaa ccagcacgta caaccatcat     11400
tttctaaata aacagaagca ggcacatcac cgacgacctg ctagttgctg cttatcagct    11460
gcattccttg actgtatccg cgtgcatttc tgccttgtgt gcacgctgaa cgtgtgctcg    11520
cagctctcaa agtccacact agcactcaca tttcacgcta gtcctactct cctaccagtc    11580
ggcagttgtt gacgcttcat aatcgaagag aaggacttga cgatataact gcatatcttg    11640
tcatttatct tcgattgggt actgaacaca tgatatattc atgtaacgct gacaagccca    11700
tcgtaccaga atcgtcttgc aattatatca ctgaacaaac tgggcacgag gtcggcatcc    11760
atatggagag cactggcgag gccatgttgc tgtcgaatgc tttgatcgat ggaagcatat    11820
atacacgttg gtctaatgaa gtaaaggagg agtataagtg agcaaaccgt cctattcaag    11880
ctacaggtta gctatagcta aggcgcacgt aactaatgct gtagaaggca cgtcatggtc    11940
caccaaatta tataacaaga taacaaagat aacaaacttt gtctcgccca atgatccgcc    12000
aggtttagct tcttttgaga ttttctattg ttattacttt ccgaancgaa gattgtcttt    12060
tgttatgctt cagcaggcct agctatgcca tgagttttgtt ttgcagtagc tatatcaagc   12120
aggagagcag tctgacaaaa gtgttgaaat cattggccta gcaccaatat gtattaacaa    12180
tagtttgtgc tgaaaatctc aaaacccccat ttgcctcatt catgtgtggc aagaggtgag   12240
actaaagttt agtgtcacat gttagttat aagcagtttg agctccatat aagqaaagct     12300
cttttccatg ttgtattacg catgcgaaaa caacacctac acgtgctcct ccgctgctca    12360
cccgatcctc acgacgcacg tcggctttcg agaatgtgtg gggctgagga accacctata    12420
caccgtgtac gagttgtctt tccctcacc acacatgttg gagaatctga aaagttttt     12480
haaaaccaaa gttgcatcaa catacaccga aggaggatga gtaggcctct agagcctcgg    12540
ctgttgtaga tctatacggg tgaggggtga tcacatttta agggnagggg gggggggggg    12600
gnncgnagca gggcactaccgc cccccntatg atccaggctt tcttcacaaa attagccatg   12660
attgcttctt atctatgttg ttttagctag cttagccccc ntaatgcaca acgtagtatt    12720
agctcagccc acctcagct aagatcctgg ctccgtccca gctaacacgg ctactggcaa     12780
acaccacgtc agaggagaac tccttccccg acaatggctt ctttctggat gtcaacaacc    12840
tcttcggcga acatgaatgc gcaggttgta ccatatgtga tcatgtcctc tctattgag    12900
attttggtag agtttcttg atgtagcat tacattaaac gtgactatca tggtaatatt     12960
ttcatcttct attttctcga ataaatatgt acatggcaat ttgcttatat attcaaacac    13020
aaagatagaa aaaacttggcg actattgctc accttttgcaa gtcttggaat taaggtcgt   13080
tcaactaaat tcacactcac tcaagccgtt acggttctca agctccatca aatgcatgct    13140
gaatcgttca acatccgtcc cgtatctccg tggaagacaa aatcgccatt agcgtgatcc    13200
accaagctat cgattgctac caagttgacc aacaccattg accttgtgtt actaaaanca    13260
cacaaacaat catttactac tgtggtaacg taatggcagc agcctaaccc gaacccttt     13320
tcaacaccgt gaccaggacg tctggcacca ccatgccact caacgcactc ttcccctgat    13380
cacaattccc atcgcgtgac acagctnccca ccccgcaaac gggccgcac ggtactctac    13440
cctccggggt aacctctctt atccctacgc acgcgcgcac cgccacggcc aaagaatccc    13500
agtagcgatc gatcgaggcc ccggccgcgt ccgccggac agcaaccgcc cgctccgtat    13560
ccgacccac accgccaccg cgcgccaccc tgcctcgccg cggccacgcc aaatactcct    13620
cccacgcgcg cgcgcgccac ctctcagtcc gtccgagtcga agccccgaa gaactcgccg    13680
gacagcgccg cctcgtctcc tcctcgtcgt caacaccgca atagaaactt ccgctggtag    13740
gtccggtcgc cccggcttca actccaccca ccaccaccgg aatcctccgc ccccaaacc    13800
gttctcctcc actcctcccg cgcctccgct cttccgtgg gcgggcgacg gggcggagct    13860
cacccaccga gtccaccgaa agcatgtgct gagcgcccgc gccactgcgc gactccaccc    13920
ctctccctc cgcgccgtta aattgctcgc cttcacact gctcctgctc ctcccgcgct     13980
ttgagagcac aacgtccgac ggggtatggg ttccagcctc aagtaccgcg ccgggctcgt    14040
cctcatcggc gccgtcgtgc tcatatgggt cacctccgcc gacgtcacgc aggtacacga    14100
aagactcagc ctcccctccc cccactctt cttccctgc ctcgttcct tctgttttaa      14160
```

```
ttgttgtttt ttttattggag acctgggatt cttgtcttgc cttgagatat tcctgctta    14220
aattaccwgc cgattaatct gatggttatt ttaaagtaac gcttttttct gggctttgt    14280
tccgccgcct gaatagtttc aactaaaaat gctcatgcct tgtttgtcct gtatggaaaa    14340
aggattcagg gtgatatata tatggacacg cttttctgt gccatttgtt ccgcgtctga    14400
atagttcaat atatcatgcg catgcttgtt gtctgtagtg gaaaagtgat caggggaata    14460
ttatggcagc atgtaggatt tggcccaatt actcttttcc tgttccatcc caatttcgtg    14520
gtcttgccat aaagtggaaa tctgcatatg tgtggaattg tattgttgca tactgttttt    14580
tgnaaagaaa taaaagttgc tatcgttgtg catctgtcat cactcatcag ttagttacgg    14640
caagtgtgca tcgccaatac acgcctggct gattctaggt gcttgcgata ttattcttgc    14700
tctcacctaa ntcatgattg tatactagat ggggaacctt actttactgt tggcaatcgg    14760
tatgttttca atttatatga cctgcccacg tttcaaagct ctagtctcca aggaacaagg    14820
aactacttac attcggctga aaagcattat ctgttcacca ggataacata tgctttttaa    14880
ttgtacaatt tttcttgttc ctttcaaaag agttctgttg tcaaatgaat caaatttcag    14940
cttcagtatc tgaactgaac ttatgtgcgc aggacatatt cgctgactac aagcaaccgt    15000
tcgcgatcac ttacttnggg gcctcccta tggtcatcta cattcccttg gcgtttctga    15060
aggatttcat atacaaattg ttgagaacgc attctggaag cagcagagcg tcaaaagtcg    15120
tgagcaaatc ttcctttggc ggcagcgctc ctctgaagaa tgtgaattt gagaagatgc    15180
tggaaatgga accgcagaaa accgtggtca tagattttac tgatgtggac atccctgtgc    15240
tagaagaggc aaaaccgctt atttgtggaa tcggtgagtt tggtgatgat gttctgaagg    15300
agcaacagct ttccaccaag gagattgcaa tttacggatt atatcttgc cccatttggt    15360
ttgtcacaga ggtaacttc caattatctg cctgtttgat ctattgagta gnttttttt    15420
tttgggtttt taatcatacc gacagtagct tgatcgatac agttgctcat cttcccttat    15480
gctcttatat ggatgcagta tttatcaaat gcagcccttg caagaacaag tgttgccagt    15540
actacggtac tatcttcaac ttcgggactc ttcacactct tcattagtgt gctccttggc    15600
caagattcca taaatgctgc caaagttat gctgttttg ttagcatggc tggtgtagca    15660
atgacaacta tgggccagac ttgggcaaca gatgaatctg aagtaagcaa ttcagggtga    15720
gtgggtttac tcaggcaatt aagcttctca gctgtgcgtt gatggtgcca actcccaagt    15780
gacctgtata ttgtcccaac ttaatttgat gttcttatga agccatgtac ttgtttgctt    15840
tgctgtaaga tggttagctg taatcaattt atttttatt ataaggaga aatcaaaaac    15900
aatttgcatt cctatgtcct gggaaaattg atgagatttt tttaatcagc ttgtaatttt    15960
ggggcagaac ttatcgcctt gctaaccatc taattcttaa gccttactac tgcagggcca    16020
cacagaggac tcttctaggt gatatgtttg gtcttctgtc agctgtgtca tatcgtctct    16080
tcactggtag gttgttgcac ttctctgttc agttcctact cgaacgtttt cagttcaatg    16140
cctaattgtt tcaacatcat tcagtgctc tcaaaaagtt tgctggagga gaacgatctg    16200
aaaaggttga tgtccaaaaa ctgttcgct ttctcggact tttcactctt tgtcttctct    16260
ggtggcttgg taagattttc ctttttgcaa atttggttgc ttaataacgt tcaaatctca    16320
atattcattg atagaaatag catgtaaaaa tggaaactgc tcttgacata tgacccataa    16380
tttatgatcc aaaatgttct gtatagtgca tgtcaatctt tatttggtat tctggtaatt    16440
ggtttagttc aaggcntcaa gcacatatac tttgattgta tttatagttg gttcttggtt    16500
tgnatgaata tacattttt gctgaagtgc ttctatcttt cagtctggcc attaactgca    16560
aatttaattg cttatgcact tattgtggct gtattcattt attaactaat ccattgatcc    16620
aaaatattcc gtgcagtatg catgtcaatg ttttatttgg gtattctggt ctaattggtc    16680
gcaaatagcc tttgtggaca ttcttctgta ggtttgttca accatatata ctttgcatgt    16740
atttatggtt tgtaatctgg tctaaatcgt gggcagatac atttgtgtc tgaggttctt    16800
ctttagtttg gttcaaccac atatagttcg catgcagtta tagttgatc ttcgtctcaa    16860
catacatgta tgcttaagta ctcttatctt ttcagtctgg ccattaactg cgctaggcat    16920
tgagccaaag tttacaatgc cccactcagc taaagtggat gaagttgttc tggcaaatgg    16980
ccttattggg agtgtgctat cagactattt ctggtacacg ttaaaaatat actggtgttt    17040
tttctttcta atatattgca taactgcgtt gttttgcaca cagaactct gtgcaggcct    17100
ctatctgttg ttttggactaa tcccttgctg gccaccttag gcatgtcact cacaattcca    17160
ctagcgatgg ttgctgacat ggtcatccat ggtcgacatt attcagcagt ctacattatt    17220
ggttctctac aggtaactga tgccctgaat ctccttattt gaggttatgt gaaaagctat    17280
atttcaaact ccttagttgc actaaacaaa acttctgttg tcatttcgga agttggaaca    17340
gctagtgaca tccccatgtt ctgtgaacct ctatctatac aagatcactc ttatttgcat    17400
ttgctatttt attcgaccct gactatttgc aggtattctc tggctttgtc attgccaatc    17460
ttgccgatcg ctttcacgt ttctgggtc tatagtcatg aaatctacaa ggttgtaccg    17520
gagtgtacat ctgtaaggtt agatcgatta gctatgnagt gtacattcgg aaatccggat    17580
tggttagtca aagacaacca tggccttctg ttcagaagga ttngggaaca agcactgcag    17640
ctatgttttt cttaaccttt tggctctctt tacacacaaa aatggaggat tttgttctga    17700
```

FIG. 15 (cont)

```
tgaaatagaa tacagtaaaa gtaggacgcg aaggcacatt atgctgtagc aaaactttgc   17760
actgtaaatt atgtagtagc ttgctgcaca atgctttctc aaccgtatac tgcatagcgc   17820
tgttattctc agcagcctca atcgtcaatg cgttattttt gcaacatgaa ttgcatacag   17880
atgatgaatt gagtcgatgg aggcactctg agacgtgtta aagttatatt atatgtccag   17940
ttgagctaca ccaaagtttc caaaactgaa atataaaatc atatatatgg gctttgttgg   18000
agtatgccca tgccataata ataggacgt aatactatat tgaacatca aacttggtga    18060
tggattgatt aaagttgata atatttcata ctttgtcaac aatagatatt actagttcga   18120
aagaaaaaca atactcgatg ttacctactc ttatcagaaa gtcaactcgg cacaacttgc   18180
cgcatgggac catatattcc tgccaccggn aaaaaaacat ttcaacatgt caaaaaattc   18240
gaacgaacat ttcaacatgt ccaaaaaaat atcgaacaa aattttcgcg tgtacgtatc    18300
gacattctat gtgcgaacat aagttttgtg aaaaacctat attttgtga attgtgtaaa    18360
aagacnaaaa aaaaatgtaa cttgtgtcaa aaagacaaaa agaaaacgtc aggtagataa   18420
ccttttttt gtaccaaaat tcatccttt tacaaatgat aaaatgtcgg tttttcggtg     18480
aaacgacttt ctgagcatgt agaattcaa gatgaactcg tcaaattttg tgtcagaatt    18540
tttcaaaatt ttaaaagagt atttaaaacg aaatttaaaa atcaggagct ctccggctct   18600
cttaaattga attctaactt gttcctatgt caaacttgtt tacatttgac cgactatata   18660
gaaaattata ctaacatgta caccaaataa gtttttatta aattagtata ctgtagatta   18720
aactttaaga ctgtacatgt ctgaagttgt agacattata attttggtac nttctccggc   18780
ccaaattaat tgacgcagaa gtaacaaatg tgtggatcca taatatgata atacagcaca   18840
cgatttgtta atttgtacag cccaaaaaca attgtatttg cttatcatat ttaacacatg   18900
catagtgcag catatacttg cgaacaacaa aaaaatctct accgttgggg tgagtcaaaa   18960
agaaatattg tatgataaac ccgtgtaacg aagcggagtc agccctctcg agaccgcgt    19020
aattcgatgc gatacacggc gaagtcgcg ttctgcgang gggcgcgcag cagcggcctg     19080
gtgaccctgt cgacctcggc cacgtcgaag ccttcttccc gcagcacgtc cacgcagtcc   19140
tgcacgcgcgc accgcacctc gctcgccgcc caacacaccg tgccgtcccg ccacagccgc   19200
cgcagcgtgg tagccattgc cggcatctcc tccgggtcgt agaagacgtc cgacatgagc   19260
accacgtcca cgcacgggac ctcacgatcg agcattacca ggtcatactc ctccccccag   19320
cgcagctccc gcacgtccgc ctgcgccgtg tcgaggtcga gccgttggc ctcggcgttg     19380
gctctaagc ccggcaggag cggccgcacg tccgtgagca cgcagcgcgc ggcgccgagg    19440
catgcgacgg ccgcgatgcc cgggaggccc gtgcctgcgc cgagctcgag cacggtggcg   19500
ccgaggagct gactgggctc ggccgaccgg aggtggttgg tgaggacgag cgccgagtcc   19560
catagccagg agccggtgag cgcgcgccg gtggccgggt cgtgcgcgcc gtccgctca     19620
accacggcca gggctcggcc ggccacatc acctgcagcg gcgcatgcat caccgtgggg    19680
ttatctgctc gatcgacctc gacggcgat cacgcgcgct ggcgtcgctg gggtctggac    19740
atcatattac ccagctttat atgcaagctt ccgaacggat gatggaaggt tcaggataat   19800
gccgggaccg ccgcctggct gtctcgatga tttgtaagct taccttcat ccatgaccgg    19860
cttggccagc catgcgtgtt caactgttca tgcaccagct aaccgaaccc ggcgattcta   19920
caggcgcgcc ggtatgtgcc cgaccttca gctttgctt tagatgcgcg                19980
ctccgttctc gggtataatg ggatgtaccg cttaccgttt ccgtttcgat actactccgt   20040
cgaataccga aagcaacgac ctgacacctg tcagatacgc caagcatctg ggcccatcca   20100
cgcccaccit ccattgaaaa tatccgctct ctacttcgcg attctctcgt tcatctagtc   20160
atggagacat cttgagcatg cggcggccgt catacagtga agataggacc tcctatacgt   20220
ctgcttcagg cccggcgtcg ccctgcagg tccgaccggt agcctccggt tccggcggcg     20280
gcgccgtcct caagatccgg tcagtagcct ccagatccgg cgtccccagg tcaaacgtcc   20340
taccggcgg ggcggccacc tccagacacg catgccgac gaaaaatacc cctgtatca      20400
tttcatcgct acctcgncc ctgtccattg tctactgtcc acctccgatg ttgagctctc    20460
atgcagatga tgggtgcctg gaggcgattg cttcctgctt cttttgattt aagttcatac   20520
agcaaatgta atgcctggta aatccattta tagttgtgta ttgttgcaac tgaaattgga   20580
atttgacaca ggattaaatg catgattaga tttgtgacta agtttattt tgaaactgca    20640
gtcgactcgt ttatcagatg aatttatcca ataaaatagt atctaagtct tcgtaattat   20700
ctttccaaag acccgatct tcatgatttt ggattaatgg ttgttgaaat atcatcaagt    20760
cagtgccgct atttcaggat ttcaggartt tcagtataaa cagatgttg tttcataaga    20820
atctatacta nttttccacac aaagtagcta gatganttcc ttctgatatt cagaatgtgc   20880
acttttttctt gatttgatga agcggttga gatttgtagc gtataacaaa tatgccatga   20940
acaattttca gaattcagct taaagaaag tcgatttcat ttatgtgtc ctctcatata     21000
tattgttcgt aagaaataga tatttagttc tctttgaatt cctctacttt gtgtattagt   21060
ggcttctgt accttctaat ctcatgttt gcaagaact tcatccagn ttctattttc       21120
cgaaattatt catggatctt gctgtctcaa tatttttgga actgaaactt cttaaaacta   21180
gtgaaagttt attggaacac ttttgaacaa taaatgaagc ttcactcgta tatttatgaa   21240
```

```
caactttgtc gaatcttnca attatttctt atctacttgc tttacaattt tgtgngnaat    21300
attattagaa cttgattcca tgcaaactga gngaactatt tgagngaaat atttctggac    21360
ttgtaatgtc attgttgcat ggttcagttc tgttgaactt atctcatagt ttgtgaaatc    21420
tttctttact ttatttggna ccagttgaat tgtggaaccg tattnaaaaa gattgtacta    21480
gtggaaaaac tgtttaaaca gatgtaacat tncccacaaa ccgaagctaa attggtgtgc    21540
tatttctgtg caacctaagt gagtttgatt taaaaaatgg ttagngaaag agatgttata    21600
tgtgaaactg aagcaaaatt cttggaaatt tattgtgaaa tattcccagg aaacctaagt    21660
gctctaattt ctcacatctg gatttccagg aatttactat ggccatgttc ttggattctt    21720
ttttcccata ggcaaaacgt tggcaaggtg cagacttcgt attggcagat gaggacgttg    21780
tgtctgaatg tggtacaata gctaacgaaa gntgcatggc acaacaacag atctggggta    21840
gcaacttgtc atgttcagct ggtggtggca aggataacga gcaacttgtt gacagatggt    21900
gggcgaatat attagaaatg atagtgtggt gatagcacta ttgtnttttct tgcanatct    21960
tctctcgtac agccagantt tagcgccaag aagagatgtg ctctatgtat gatcntgtaa    22020
tgttgtttcg acctttgncc tgttacagct tntttgtgga acttgcttga cttanctgaa    22080
ttccatctta acatgtttgc tccatttcta gactgggacg atttntataa aattatgaaa    22140
tgcatgttag tatatgcntg gaacaatttt ggtatgaatc atgtaattcg tctagttgac    22200
tatttgtgag attttttcgc ttgtgcaaat aacatatcaa gctagcattt atccnagtca    22260
cctataaact acantttnca cttgtatcgt cncctatgtt gagaccctac agaaactaac    22320
tagaaactaa agtagcgcat caatgaaaca aataactttna ctgaaacttc ttgnaaccat    22380
agtggaaaca agcagccatg ttaagtctgg anagaacatg ccagnaaatc gattgtgaca    22440
ttagcaatac caaataantc tgaaaccaac tgaaaacttc attnaaaacat tagtnaaacc    22500
cataacttct ctaaaacctt attgaaattc tgaataaaac atgaagccat atgnaaccrt    22560
gatggagtat accacaaanc tgcatgagge attagtgcna cccaaatant tccnaaaatt    22620
tgnactttta aagtaacaat tcatgtttca atagtttcac atatgtttca ctaangtatg    22680
gtttatggtt gagtacgact acatgcatat tncactatct ttctncaata aatcaaaata    22740
tnattattcg ttggtctntg catcccatac cgaaagtcga atgtacgttc gtaanttgt    22800
ttttcttaacl gcgagtaatg gaatgtacat agggtaccca tggaaaaatc atgaagttca    22860
tgtttcaatt aagtaccaat tgtagataca actcttttt agatnttact tantntttttt    22920
taggatggac tatgtttcac gagttctcca tgcatgtttt gcttatttaa cgataaagga    22980
tagaaaatgn ttcaataaat ttatcctata gnttcacttt cttgatcatg tttcatatta    23040
ttttgataac ggatggaccg tgtttcacaa aaaatttaat aattntgggc tatangaatg    23100
tattttacaa gttgatcatg gaatcatggg agagtttcac taggnttggc atgcntcata    23160
ttagtatgaa aagatggaag tgcttttact tnttttttgca tcaangtaag atctaggttc    23220
caattgtttc acaaataatt cattaatgca tgtgttatag gaaagtattt cacaaattga    23280
ccatcgatgt ttttccaaat aatactatat cataaaagct ttcangattt atcactagag    23340
tttgaaatat aataatcnag tttttttttca tntgtaagcg aattgagctt gttnttatgt    23400
ttcatttaat ggtcgaaata aacatattgt agtcnttttt tttnaaccat ggagngttct    23460
accatgttcg gcgtgntnca tattagttcg aaaatgatag aaggngtttc tattntattt    23520
tgcatcaatt cacgagcnag gttctaattg nntcaaaaat tattcaataa tatanaggct    23580
attggaatgt gnttcacaag ttgaccatgg aatccttcta gtatnttact tggatggtca    23640
tgttgcacat tagtttgaaa tagatggacg angttcgttt tttgnatcaa agtaatatcc    23700
nttttccaa ttgttgcaca aattattcaa taatgcagag cctangggaa tgtgnttcac    23760
aagttcacca ntcaatcctt cttgtctttc aattgttttgq gcatgattcc tattaattag    23820
aaaagtatag agtgtgtnta aatttttttg aatcaactgt aatanctagg tttaagatat    23880
ttcacaaaaa tgtcaantaa ttcgggtata tgcatgtgtt tctgaagggtg acaagngaat    23940
catgggagtg tttcactngg tttggcatgt tncatattag tatgaaaagc atanaggtgg    24000
tttcactttt ttttgcatca atgtaagatt tacgctccaa ttgtntcaaa aataattcaa    24060
tgatgcatcg gttatatgaa tgtgtttcac aagttgacca tggaatcctt ctangtttc    24120
actcggatca ctgtgttccg cattagtttg caatggatgt aggtngtttc gatcnaggtt    24180
ccagttgttt caccaaaaat ccaataatgc anggactata ggaangtgtt tcangagttc    24240
atcatgcaat cattctagtc tttcatttgg cngggcgtga ttcanaatag atanaaaaga    24300
tggaaggtat ttcacntntt ttttttgcatc aatgtgtttt cccaacaatt tcaanatttt    24360
tgggttatag gccggangt gtttcacaag angccgtgg aatcatggga gaatntcact    24420
agqtttggca tatttcanat tactatgaaa tggatggaag tggtntttttt tttgcatcaa    24480
cgtaagatct aggttccaga ttttccacaa anagttcaat aatgcatgtg ttagaagaaa    24540
gtantncaca agnttaccat ggnaattttc ccaataatct ataggggtgcc atnaantttt    24600
acatgatttg tcactagagt ttcaaatata gnaatctagt tgttgcgttg gtaagtaagc    24660
aaattgatct tgttttttnta tgtttcgtta nccgtcgaaa tgaaaatatt gtatnttatc    24720
atgcgagtgt ttcacttngt tagggatgtt tcttattagt ttgaaaagga tagagggtgt    24780
```

FIG. 15 (cont)

```
ttccctttta ttttgcgtca atgcacaagc tctcggttcc aattgtttca aaaatatttc   24840
aataaagtat gggctagtga aatgtgtttc acaagttcac catggaatcc ttcaagcgtt   24900
tcacttggat gggcatgttc cacattagtt tgaaatgcat ggatggtgnt tcactttttt   24960
taaatgtaat atcttgtttc caattgtttc acattattca ataatccaag gcccattgca   25020
atgtatttca caagttcagc attcaatctt tctagtgttt caattggttc tacatgtttc   25080
ctattaatta caaaaatatg gagtgtatnt cantttttttt gaatcaaatg tctgtagg    25138
```

FIG. 15 (cont)

LpOs05g0148600

ATGGGG[A/G]CGGA[C/T]TTCGG[A/G][A/G]CGGAGTTGGG[A/G]GCGCT[C/T]GCTCT[C/G]AAGT
ACAC[C/G]GGG[A/G]TGTCGCTCTCGGTGTCGGACTACGACTCCAT[C/A]GTCGCCATGAACATCTTCGTC
GC[A/G]CTCCTCTGCGGCTGCATTGT[C/G]TTCGG[C/A]CACCTGCTCGAGGGGAACCGCTGGGTCAACGA
GTCCACCACCGCGCT[C/A][A/G][G/T]C[C/A][A/T]GGTG[C/T]TTGCGGTTTTGTCTCGC[A/T]GG
GGC[C/T]GGGTGGCAT[C/G]GCT[C/G]AT[C/T]ACTGGAGGGGT[C/G]ATCCTGCTCGTCACCAATGGG
GTCAATTC[A/G]CGCATTCTGGT[C/A]TTCAGCGAGGATATATTCTTCATCTACTTGCTCCCGCC[C/A]AT
CATCTT[C/T]AACGCTGGGTTTCAAGTAAAGAAAAA[A/G]CA[A/G]TTCTTCCGCAATTT[C/T]GCAAC[
A/G]ATTACTTTGTT[C/T]GGGGCTATTGGGACATTG[A/G]TATCCTTTGTAATAATCAGC[C/G]TTGGTG
CCATGGGATTGTTCAGCAAACTTGATGTTGATCCACTCCAGCTTGGGGACTATCTTGCAATTGG[G/T]GCTAT
CTTCTCAGCAACAGATTCTGTTTGCACCTT[A/G]CAGGTGCTTAACCAGGATGAAACACCCCTACTCTATAGT
CTGGTTTTTGGTGAAGGTGTTGTTAATGATGCTACATCTGTTGTGCT[C/A]TTCAATGCAATT[C/G]AAAAC
ATTGATCTTGATCATTTCGATGC[G/T]TTTGTTCTACTACAACTTATTGGAAAATTCCTCTACCTACT[G/T]
TTCACCAGTAC[A/T]GTTCTTGGAATAGCT[C/T]TGCTGGATCT[A/G]AGTGGTATTCTCAC[C/T]GT[A
/G]TTCTTCTGTGGAATAGTAATGTCGCATTACAC[C/T]TGGCATAATGTGACAGAAAGCTCTAGGGTTACTA
CCAAGCATACTTTTGCAACCTTATCATTCATTGCTGAA[C/T]TATTTCTTTTTCTCTACGTTGGGATGGATGC
ATTGGACATTGAAAAATGGAGATTAGCTAG[G/T]AGTAGGGAGCTAATAATATGGTGGGCAGGTCT[C/T]AT
GAGAGGAGCAGTTTC[A/G]ATTGCACTTGCTTA[C/T]AACAAGGTTTT[C/T]GGCTTGCTGACTAAGCCTC
TGATTAATCTCCTCATCCCACCAAGGCCTAG[C/T]AATACAGCTGATGGCTCAAGCCAGTCATTCCTTGACCC
[A/G]CTTCTGAGTAGCTTATT[A/G]GGCTC[C/T]GACTTGGATATTGGCCAATACCC[C/A]CCTCAAAC[
C/T]AACCTT[C/G]AGCTTCTTCTCAC[C/G]ATACAAACACGTTCTGTTCATCGTGTGTGGCG[C/T]AAGT
TCGATGAT

FIG. 17

LpOs01g0369700

ATG[A/C]CAATACACTCT[C/T]TT[C/G]TG[A/G]AAA[C/T]CTG[A/G]TTA[C/A]TATGATAGC[C/
T]CC[C/G]CTTGCTCCCATAAGGCA[C/T]CAGCTTGCATA[C/T]GCAACCCACACTTTCTTCGA[C/T]AA
AGAGGATTTCTT[A/G]TATATCCATAC[A/T]CCCATAATAACCACCAG[C/T]GA[C/T]TGTGAGGGTGC[
C/T]GG[C/T]GACATGTTCCAAGTCAC[C/A]TCCTT[A/G]TTCAG[C/T]CAGGC[C/T]GAAAAGGTTGA
[C/T]AAGGAGCT[C/T]AAGGAGAACCCTGC[A/G]CC[A/G]TCTGAAGCTGAT[A/G]TGAGGCTGCTAA
GCTTGTTGTCAAGGGAAAAGG[A/G]GATGC[A/G]GTTGC[A/G]CAACTTAAAGCA[A/G]CAAAAGCTAGC
AAGCA[A/G]GAGATAACTGCTGCTGTTTCGGAGCTTACAAAGG[C/A]AAAAGAG[A/G][C/T]TGTCTTAA
GGCTGGAAGA[A/G]AGGTC[A/T]AAG[C/T]TGAAACCTGG[A/G]ATTCC[C/T]CA[C/T]A[A/G]AGA
TGATGG[C/G]TCCATTGCGTTTGAGAATGACTTCTTCAAGCGTGCAGCCTTTCT[A/G]ACTGTTTCAGGCCA
[A/G]CTTCAGGTTGAGACTTA[C/T]GCTTGTGCTCTCAGCAGTGTCTATACCTTTGGACCCACATTCCGGGC
AGAGAACTCACATAC[A/G]TCAAGACATTTGGCAGAATTTTGGATGGTTGAACC[A/G]GAAATTGCATATGC
AAACTTGCATGATGATATG[A/G]ACTAT[G/T]CAGAGAGGTAC[A/G]TAAAATACCTCTGCAAATGGTTAC
T[C/T]GATCATTGCCGTGAAGACATGGAATT[C/T]ATGGTGAAACATGTGGACAAGACTGCAATTGAGCG[C
/T]CTGGAGCTTGTTTC[G/T]TC[C/T]ACACCCTTTGAGCGCATCTCATATAC[A/T]AAGG[C/T][A/T]
GTGGAGATCTTAGAA[C/G]GTAC[A/G]GGTAA[A/G]AAATTTGAGAACAAGGTTGAATGGGAATTGATTT
AGC[A/G]TCTGAGCATGAG

FIG. 18

LpOs05g0149100

TCTCGGGAAACACGCATTGGCAATACCGGCCGATCGATCGACAGATCGGCACGGGGTCCGGCGAGGCGCGATGG
CGTATCGGGTGCTGGAGGTGACGCTGATC[C/T]CGGCCAAGGACCTG[A/G]AGAAGGTGACGGTGT[C/T]C
[C/T]CCAAGATGCG[G/T]GTGTACGCGGT[A/G]GC[A/G]TCCA[C/T]CTCCGGCGGCGACCCGCGCACG
CCGAC[A/G]CACC[A/G]GACGCACTCGGAC[C/T]GGCA[C/A]GGCGGGCCGCTGCGGTTCCCAAT[C/A]
CCGATCGC[C/T]GCCGACCCCGCGGGCTCGCACTGCACGTGCTCCTCCGCTCCGA[A/G]CGCTCCTTCGGC
GACCGCGACGT[C/T]GGCGAGGT[A/G]CTCGTCCCCGTCCAGGACCTTTTCGCCGCAGCGCCTC[C/T]CGC
CGGCGAGCATCGCCACCTCAGCTACCAGGTGCGACGCCCCATGAGCGGCCGGAAGCGCGGGGTGCTCCACATCT
CCTACAGCCTCACGGACGCGCCGGCGATAGGG

FIG. 19

LpOs05g0149500

ATGCGCGTCACCATCACCGGCGGCGG[C/G]A[C/A]G[C/A]GGCTGCACGT[A/G]GACCTCTACTACGCG[
C/T]GCGT[C/G]CAGAGCCGCGCGC[C/T]CTTCACGGT[A/G]TG[A/G]AGCCTCCTGCAGCT[C/G]ATG
CGGCGGCACC[C/G]CGGCCG[C/G]GTCCC[C/G]GAC[G/T]TGGACCTCATGTTCGACTGCA[C/T]GGAC
CG[C/G]CC[C/A]GCCATCAACCGCAC[C/T]GAGCA[C/T]A[C/G]CG[C/G]CGAGGGCGCGCC[C/G]C
C[G/T]CCGCC[A/G]CCGCTGTTCCGGTACTGCACCAC[C/T]CG[C/G]GACCACTT[C/G]GACATCCCGT
TCCC[G/T]GACTGGTCCTTCTGGGG[C/A]TGGCCGGAGACGCAC[C/A]TCGAGCC[C/G]TGGAGCCG[C/
T]GAGTTCAA[A/G]AGCAT[C/T][C/A]GGCAGGGCGCCAAGAAGAACTGGGACGAGGAGGCGAGGTCCGG[
A/G]TACCAGAACTCGAAGCT[A/G]TCGAGCCAGTGCACGCACCGGTACAAGATCTACGCGGAGGGGTTCGCG
TGGTCGGTGAGCCTGAA[A/G]TACAT[C/T]CTCTCCTGCGGCTC[C/G]ACGGCGCTCCTGATCGACCCG[C
/A]TGTACCAGGACTTCTTCAGCCGGGGCTGGAGCGCGGGTGAA[C/T]CACCTGCCGGTGAGC[A/G]CCG
T[C/G]GGGATGTGCGAGTCCATC[C/A]GGGACGCCGTGGAGTGGGCAACGCGCACCCGGACGAGGCGGAGC
GCGTCGGGCG[A/G]CGCGGGCAGCGGCTGATGCAGGACCT[C/G]GCCATGG[A/G]CGCC

FIG. 20

LpOs05g0149600

ATGGCGGG[C/G]CAGGGGCAGGACCGCAAGACCATCGATCTGGAGGAAGGATGGGCCTACATGGAGGGCGGCA
TCGGCAAGCTCGTCAACATCCTCGAGGGCAAGAACGAGCCGCAGTTCAACTCCGAGAACTACATGATGCTCTAC
ACGACGAT[A/T]TACAACATGTGCACGCAGAAGCCGCCCAACGACTACTC[C/G]CAGCAGCTCTACGACAAG
TACCGCGAGGC[C/A]TTCGAGAAGTACATCCG[C/A]GACGCGGTCTTGCCAGCAAT[A/T]AAAGAGCAGCA
TCATCACTATATGCTAAAACAGCTAAA|C/A|GTAAGGTGGAACAACCATAAACTCATGCTTCGCTGCCTTTCA
CGTTTCTTCCATTA[C/T]CTTGACCGATACTTCATCACCCGGAGGTCTCTTACTCCACTTAATGATGTTGG[C
/G]T[A/T]TATTTGCTTCCGAGACTTGATATTTCAAGAGATCAAAGGAAAGGTGAAAGATGC[A/G]GTG[C/
T]TAGTTCTGATAAATCAAGAGCGTGAAGG[C/T]GAACAGATTGACAAGACCTTGCT[C/G]AAGGACGTC[C
/T]TGGATATATTTGTTGAAAT[C/T]GGGTTAACTAC[C/T]ATGGAGTTTTATGAGAATGACTTTGAAGATT
TCTTGCT[C/T]AAGGATACTACAGAGTACTATTCTGTCAAGGCTCAAAA[C/T]TGGATCGTTGAGGATTCTT
G[C/T]CCAGATTACATGATAAAGGCTGAGGAGTGCCTGA[A/G]AAGAGAGAAGGAGCGAGTT[A/G]GTCAC
TACTTGCATATTAACACTCAGCCAAAGTTGCT[C/G]GAGACACTGCAAAATCAATTGCT[C/T]GCCAACTAT
CCAAC|C/A|CAACTTCTGCAGAAGCAACATTCTGCATGTTATCCA|C/T|TCCTTCG|A/G|GATGACAAGGT
GGATGATCTTAAAAGGATGTTTTC[A/G]CTCTTCTCAAAAATCACCCGTGG[A/T]CT[C/G]GAACCTGTTT
CTAACATGTTCAAATCGCATGTTACGAATGAGGGTACAGCTTTGGTCAAGCAAGCAGAAGATTCTGCTAG[C/T
]AATAA[A/G]AAGCCAGAGAAGAAGGAGATGGTTGGAATGCAGGAACAGGTTTTTGTCTGGAAAATCATTGCA
CTGCATGATAAGTATGTAGCATATGT[C/G]ACAGATTGTTCCA[C/T]GGCCATACACTCTTCCACAAGGCA
CTTAAAGAAGCCTT[C/T]GAGGTCTTCTGCAATAAGGGTGTCTCTGGCAGTTC[A/G]AG[C/T]GCTGAATT
[A/G]CTCCCCACCTTCTGTGACAACATT[C/T]T[A/G]AAGAAAGGCTG[C/T]AGTGAAAAGCTCAGTGAT
GAAGC[C/T]ATTGAAGATGCCCTTGAGAAGGTGGTGCG[C/G]CTGCT[C/T]GCATACATAAGTGATAAAGA
[C/T]CTCTTTGCTGAGTTCT[A/G]CAGGAAGAA[A/G]CT[G/T]GCAAGGAG[A/G]TTGCT[A/T]TT[C
/T|GACAA|A/G|AGTGCTAATGATGA|A/G|CA|C/T|GAAAGAAGCAT|C/T|CTGAC|A/G|AAGCT|A/T
]AA[A/G]CA[A/G]CAGTGTGGTGG[G/T]CA[A/G]TTTACTTCAAAAATGGA[A/G]GGCATGGT[C/T]A
CTGA[C/T]CTTACT[C/G]TTGCAAGAGATCATCAAACTAAGTTTGAAGAGTTTGTAGCTGAACATCAAGA[A
/G]TTG[C/A]ATCCTGGG[A/G]TAGACTTGGCTGT[C/T]ACTGT[C/T][C/T]TGACAACAGGATTCTGG
CCAAC[C/A]TA[C/T]AAA[A/T]C[A/T]TTTGA[C/A]ATAA[A/G]CCTTCCT[G/T]CTGA[A/G]ATG
GTTAAATGTGTAGAGGTTTTCAAGGAGTT[C/T]TACCAAACAAGAACAAAGCACAGGAAGCTTACCTGGATAT
ACTCGTT[A/G]GGAAC[C/A]TGCAATATCAATGCAAAATTTGAAACCAAAACTATAGAGCTCATTGTTACAA
CATATCAGGCTGCGTTGCTGTTGTTATTCAATGGAGTTGATAGGCTTAGTTACTCTGAGATTGTAACACAGCTG
AACCTGTC|A/G|GATGATGATGTTGTGCGTTTGCTCCATTCTCTGTCTTGCGCTAAATACAAGATTCTTACCA
AAGAGCCAGCTGGTAGATCTATTTCTCCCAATGATGTTTT[C/T]GAGTTCAATTCAAAATT[C/T]AC[C/T]
GACAGGATGAGAAGAATCAAGATACCCCTGCCTCCTGTTGATGAGAAGAAAAAGGTTGTTGAAGATGTTGACAA
GGA[C/T]AGGAGGTA[C/T]GCAATTGATGC[A/G]TCGATTGT[C/G]CGTATCATGAAAAGCCGCAAAGTC
ATGGCCCATACCCAGCTAGTTGCGGAATG[C/T]GTGGAGCAGCTCAGCCGCATGTTCAAGCC[C/T]GACTTC
AAAGC[A/T]ATCAAGAAGCGGATTGAGGATCTCATCACCAGGGACTACCTGGAGCGTGACAAGGACAACGCCA
ACACATACAGATATCTGGCTTGA

FIG. 21

LpCs05g0150400

ATGGGGTTTGGTCGATCTCGCTGGACAGGCAGTACAGCACTGGTTATTAATTGGAGACCACTTCTCTACTGCAG
AAAAGAGGATATCAATGGTCACAGTGGGCTGAGGAGAGATTTACCGGTTGCATCTTTGCTTCTTCGGGTGGATG
CAAGCATGTATAAGAACCAGCTCCAGGAGCTTGCACAGAGGAGCTGCTTCAACTTGCCATCCTATGCATGCATA
CGCGAGGGGCCGGATCATGCACCCCGGTTTAAGGCCACAGTTCATTTCAATGGGGAAGCATTTGAGAGCCCGAC
ATTCTGTTCCACCTTGCGGCTGGCGGAGCATGCGGCAGCTGAGGTAGCACTCAATGAGTTGTCCAAGAGGGGGC
CTTCATCATCACTTGCTGCTAAAGTTCTGGATGAAACTGGGATCTA[C/T]AAGAACCTGCTGCA[A/G]GAAA
CT[G/T][C/T]TCATCGGGC[C/T]GGTTTAAAACTGCC[C/T]ATGTACACTACTATTAG[A/G]TCCGGAC
CAGGGCATACACCAATGTTCACTTGTACAGTGGAGTT[A/G]GC[A/G]GGAAGGATCTTCAC[A/G]GGCAAT
CCTGGCAAGACTAAGAAACAAGCTCAAAAAAATGCTGC[G/T]ATGGCTGCCTGGTCTGAATTAAA[A/G]GAA
TTGCCT[C/A]GAG[G/T]AGG[C/T][A/G]AGG[C/T]AGCATCTTCATCTTCTCCATCCGATCATGACAAT
G[A/G]GGAGCAGGAACAGGTCACAGTTGTCCGCACTCTTGAAA[A/G][C/T]TTGAACCAGAAAAATGAAG[
C/T]CAACCC[C/A][C/G]C[A/G]CATCAAAAGCAAAAGCACCAACGCAATAACCGC[C/T]CGCAACCTCG
GAGATC[A/T]T[A/G]TCCTAAACCAAGTG[C/T]GTCATTTTA[C/T]GGATCACGCTTACAAAATCAG[A/
T]C[A/G]T[C/A]CCCAAATGT[C/T]GCACAA[A/G]AGCAAGCAATG[C/T]ACCATATGTGGCACCAGGT
GCA[A/G]CCAACACAGCAGAAG[C/A]CCCA[G/T]TTTCGGATGGTTCCAACT[A/T]TGGGCAACACAAGG
TTTCCACCGCCACCAAC[C/T]ATACT[C/T]TCCATGTACCCTCCACCTAGAGGACA[A/G]T[A/T]C[A/G
]C[C/T][A/G]TGC[C/A]AGCCA[A/G]CCAAGATGCTTTGGCTCTA[C/A]TTC[C/A]ATGTTTTCCTGA
A[C/G]CTGCTCCT[A/G]CCCTTCCACGGTA[C/T]TTCTC[A/G][C/T]CTTACCCTGCCTCATACGTACC
A[A/G]CAAGTCCA[C/T]TGCCA[A/G]CT[G/T]CA[A/G][G/T]TAACATGATGCATGGGAGAAG[A/G]
CAAGGGTG[C/T]G[C/A]TGAAA[C/T]GGTTGAGCTTCCT[A/G]ATGC[A/G]CC[A/T]GTTTTC[G/T]
[C/G]CAGATACACTGCTC[C/A]AGATT[A/G]CTCTA[C/G]TGCTCTGGAAAATGTTTGT[C/A]CAAGTG
AGGTTCAACA[A/G]TGGCCTAAAAATGGGAAGAGG[C/G]A[A/T][A/G]T[C/A]C[C/T][A/G]AGAG
[C/T]AGTG[C/G]TGC[C/T]ACCGAGGAA[A/G]AGAATAAAGCTCCCCAG[A/G]CTTC[G/T]TCAAGCT
CCACA[A/G][C/T][A/G]CATC[A/G]CCCATCACAAAA[G/T]TT[A/G]GAA[C/G][C/A]AAATGAAG
ATA[A/G]A[C/G]AGTC[G/T]AA[A/G]AA[A/G][C/G]CAGCAGAACA[A/G]CCACTTCT[C/T]GGTC
CATA[C/T]GTTGTACAAAGACCTG[C/T]CCAGC[A/G]ACAGA[A/G]TTATCCTA[G/T][C/T]CCC[A/
G]TGCAGCACAG[C/T]GAGCCT[A/G]TCCA[C/T]AGAAAT[A/G]ATCTTCC[A/G]TTCAGGA[C/T][A
/G]G[C/T]AACATCACCTG[A/G]CCCATGG[G/T][C/T]TT[C/T]GGACATGCA[A/G]ACTCCACCAAG
ATTTGG[C/T]ACTG[C/G][A/G]A[C/A]TCTTGCGAATTCAGCC[A/G]GT[C/T]TCTTATACCAGCAGC
G[A/G]CCTCCATGGCTGGC[A/G]GCCCAGTTACAGTT[C/A]GAACTTCTATCCCTGTGTGTTCAGCTAGA
CCAAACGCAGCGGTGAACTCTAGCCCGGGAGCAGCAACTCGAGTCCGATCTACTGTCCAGATGCTCTCTAGAAA
TAACTCTGAGGCCCAGAGGAACACGAGAGACATGAGTGATGCTTCGACAGCAAGTTCAGAACTTAGTAAGCTCC
ATATCTGA

FIG. 22

LpOs05g0150500

CCCAACATTCACATTTCCTCCAATGCTCGTAATGTTTTTGCATATAATGGACCAGTCAATTTCACTGTACTTGA
GAGGCTAGTAAGCAGATGCCGCAACCTCAAGACTCTGAAGCTCAACAATGCAATCCCTCTTGACAATGTTGCTA
GCCTGCTTCGTAAGGCTCCGCA[C/A]ATA[A/G]TAGAACT[C/T]GGAACTGGCAAATT[C/T]TCTGC[G/
T]GA[C/T]TATCATCC[A/G]GATCT[C/T]TTTGC[A/G]AAG[C/G]TTGA[A/G]GC[A/G]GCATTTGC
AGGTTGTA[C/A]AAGCCTAAGAAGGCT[A/T]TCTGGG[A/G]CTTGGGA[C/T]GCTGTTCCAGATTACCTG
[C/T]CAGCATT[C/T]TAT[G/T]GTGTATG[C/T]GAA[A/G]GCCTCACATC[A/T]CTTAA[C/T]CTGA
GTTATGC[C/T]AC[C/T]GT[G/T]C[A/G]AGGCCCTGAGCTCAT[C/T]AAATT[C/T]ATTAGCAGATGC
AACAATCTGC[A/T]GCA[A/G]TTATGGGTGATGGA[C/T]CTCATTGAGGACCATGGTCTA[G/T]CT[A/G
]T[C/T]GTGGCATCAA[C/G]TTGCAGTAAACT[A/G]CAAGAGTTGCGGGTCTT[C/T]CCTTC[C/T]GA[
C/T]CCTTTTGGTCATAACG[C/G][C/T]GGGCA[A/G]GTTTT[C/G]TTGAC[A/T]GAAAG[A/G]GG[C
/T]CT[C/T]GTTGATGTTTCTGCCAG[C/T]TGTCCCA[A/T][A/G]TTGGA[A/G]TC[A/G]GT[C/T]C
T[C/T]TACTTCTCCAC[C/G]CGGATCACGAATGAGGCTCTT[A/G]TTA[C/T][A/G]ATTCCAAAGAACC
GTCC[C/A]AACTTCAC[C/T]TGCTTCCGC[C/T]TA[G/T][C/G]C[C/A]TCCTTGA[A/G]CC[C/T]C
GT[A/T]CTCC[A/G]GATTACAT[C/G]ACAC[A/G][A/G]CAG[C/T]CTCTTGATGC[A/T]GGTTTCAG
TGCCATTGT[G/T]GAATCATGCAAGGG[C/G]CTTAGGCGCCTCTCT[A/G]T[C/G]TC[C/T]GG[C/T]C
TTCTC[A/T]CAGATCTTGTATT[C/T]AAATCAAT[C/T]GGTG[C/A]ACATGCTGATCGTCTTGAGATGCT
[A/T]TCA[C/A]T[C/A]GC[C/A]TT[C/T]GCTGG[A/G][A/G]ACAG[C/T]GATCTAGGCCTG[C/A]
A[C/T][G/T]A[C/T]ATCCTCTC[A/T]GGCTGCAAGAGCCT[A/G]AAGAAGCT[A/G]GAGATCAGGGAC
TGCCC[A/G]TTTGGG[A/G]ATAA[A/G][C/G]CGTTGCTGGCAAATGCTGCCAAG[C/T]TGGAGACAATG
CGATCCCTTTGGATGAACTCGTGCTCGTTGACCGTGGGCGGGTGCCGACTGCTTGCACTCAAGATGCCTCACCT
TACTGTGGAGATAATAAACGATCCTGGAGAGACATGTCCAGTGGAGTCACTCCCGTTTGATAGCCCTGTCGAGA
AATTGTATGTCTACCGGACTCTTGCAGGTCCTAGATCTGACACACCAGACTGTGTCCAGATTGTTTAG

FIG. 23

LpOs05g0151300

ATGGCGCAGTCC[A/G]GCAGCGACGCCGC[C/A]CCGATCAGCAC[C/G]CACCCCACCGAGGAGGAGGAGGT
[C/G]ACGGTGGAG[C/A]GGACGCC[C/G]GAGGAGGAGG[C/A]GGCCAGGCTCAGGTACCTCGAGTTCGTG
CAGCAGGCGGC[C/G]GCGCAGGCGGT[C/G]GTGCT[C/G]GCCGC[C/T]GCGGCCTACGC[C/G]TACGC[
C/G]AAGCAGGGCGCGGGGCCGC[C/A]GG[C/A]GTCGACCACG[C/A]T[C/G]CCGCTCGACCTCCTCA
CGTCGGCCCTGT[C/G]TA[C/T]GA[C/T]CG[C/G]TACCACGCC[A/G]T[C/G]CCGCTCGACCTCCTCA
AGTTCCT[C/A]GA[C/T]CGCAAGGTTGACGAGTCCGTCCAGGAGCTGGACCGCCGTGTCCCCCCAGTTGTGA
AGGAGGTGCCAACTTATGCCCGCTCTGCGGCGGCTGAGGTGCACAAGACCGGCTTAGTAGGCACAGCCACGGGC
CTGGCCAAGTCGGCCATTGCTCGTGCTGAGCCAAAGGCTCGCGACCTGTACACCCGCTACGAGCCTGTGGCGGA
GCGCAAGGCTGCCGAAGCATGGGCTGCCCTCAACCGCCTCCCGCTTGTTCCATCGGTGACCAGGGCTGTCCTCC
CCACCGCTGCACAGCTCTCAGCCAAGTACAACTCTGCCGTGCTTGACGGGGCCAAGCGCGGGAACTCTGTTGCC
ACCTACCTCCCGCTTGTCCCCACGGAGCGCATCGCGAGGGTGTTCTCCTACCCGCCTACCGACGCTGCTGCCAC
CTCGGCTCCTGAGATGCAGCCCATCCCGACGCAGTAA

FIG. 24

LpOs05g0152400

```
ATGCTGCGCCTGACCCTGCCCTGCCCTTCCACCTTGCTGATCTGGCAGGAAATTCTCTCATGGCACCGGATGAC
CTGCAGACCACCAGCCCAGGAGATATCCCTCACTGAATGGTGGATAGAAGCAAGACAACGCCTGGCCCCCGCGA
CGCTGCTCATCCTGTGGATGACCTGGAAACACCGCAACAGTTGCGTGTTTGAGGGTGCACAACCTTTGATCAAT
GGTCTGATCTCCAGCATCAAAGATGAAACAATTCTCTGGGCTAAAGCCAGTGCCACTGGCCTAGGAGTAGTGAC
CGATGACCTGGGATGTTCTCCATGGGTTATTCTAAATCGG[C/A]GGTTTATAGAGTATTGTATTCTTGGCTGG
GAGAATCTTCCTCGGGTTCTTCTCATGTACTTCAACAACGTAGTGCTGCCTCAGGAAGGATA[C/T]TTCCACT
CAGTCATATGCAACTCGGTTGATTTCCGTAATTCCACTGTGAACAATGATTTGAGGTACAAGGTGTGGGATGAA
CCACCTCAGACAGAGCCCCTATTTCTGAACATGGCACATTATGATGAGATGGTGAACAGCGG[A/G]CAGCCTT
TTGCAAGGCGTTTTCAGAAGAAGGAAC[C/G]ATTGCTG[A/G]ACAAGAT[C/A]GATGACAAACTACTCAGG
CGTCCTGGGCATGGGCCTGTTCCTGGTGCCTGGTGCTCAGGCAGGAAGGGCTGGTTCGTTGACTCATGTTCCCA
GTGGAGTGACGTGAACGTTGTGAAACCTGGTCCTCAGGCCTTGAAGTTGCAGCAATATATCAATCGGACATTGG
AAGAAGCAAATTCTGGCGCAAAATCATGCAGGCGATAG
```

FIG. 25

LpOs06g0680500

```
ATGGGGCCCCCCGACCTCCTGTCTTTGTCCTTGGTACTCGCTGCCCTCCCATGGACCCAGGGGCACCGGCCCCG
CGCGGTGAAAGTGGGCGCGCTCTTCGACTACGATTCCACCATTGGCCGCGCGGCGCAGCTCGCCATCGAGCTCG
CCGTCGACGACGTCAACGCGGACCGCTCCGTGCTCGCAGGGACCAAGCTGGACCTCATCACGGCGGACACCAAC
TGCAGCGG[C/T]TT[C/T]GTTGGAACCGTCCAAGCACTGCAACTAATGGAGAAAAATGTGGTTGCAGTTGTT
GGCCC[A/G]CAGTCCTCTGTGATAGGCCATGTCATCTCACATTTTGTTAATGAGCTGCATGTTCCGCTCCTAT
CATTCGCAGCCACTGATCCAACTCTTTCTGCATC[A/G]GAGTATTCTTACTTTTTAAGGAGCACTGTCAGCGA
TTACTTCCAAATG[C/T]GTGC[A/G]ATTGCTAGCATTGCTT[C/A][C/T]TACTATCAATGGAAAGAGGTA
ACTGCTATATTTGTTGATGATGATTATGGGAGAGGTGGGGTGTCTGCCCTTGGTGATGCCCTTGCAACAAAGCG
TGCCAGAATTTCATATAAAGCAGT[C/A]ATTCCTC[C/T]AGATGC[G/T]AACAAAGATGTGATCAGTGATA
TACTGTTTAAAGTTAACATGATGGA[A/G]TCAAGGGTTCTGGTTGTGCATGTCAATCCTGATACAGGGCTGCG
A[A/T]TATTTTCTATAGC[C/T]AACGAGCTCCAGATGATGA[C/G]CGGTGGCTATGTCTGGATTGTAACTG
ATTGGCTAGCTGCTGTCCTGGACTCCTCAAAGTC[A/T]GGATATCCGAAGA[A/G]CATGAGTTATATGCAAG
CATTAATTCCCCTTCGTCAGCACATTCCTGATTCTCCTGCCAAGAACAAGTTCATATCAAATGCAATA[C/T]
TG[C/T]GGCTCGCAAAACGAAAATTGCATCTGGTTTGAATTC[C/G]TATGGTTTTTATGCTTATGA[C/T]T
CT[A/G]TTTGGATTGTTGCCCATGCGATTGA[C/T]AAATTTCTCAA[C/T]AGTGGGCAG[C/A]AGATCAA
CTTCTCTGCAGATAC[A/T]AGATTGCACGATTCGGATACAAGCATTATCACTCTGTCAACTCTCAAGATATTT
GATGGTGGTGAACACTTGCTACAGCAACTTCTGCTCACAAACTTT[A/G][C/A]AGGCCTA[A/G]CAGGTCT
GGT[C/T]CAATTTGAT[C/T]CAGACCGCAATTTGGTACACCCAGCATATGAGATCCTTAACATTGGTGGTTC
TGTTCCTG[A/G][A/T]TTGATTGGCTATTGGTCTAATTA[C/T]TCTGGCCTTTCTGTTGCTGCTCCTGAAA
CTTTGTATCAGAAGCCACCAAATATGTC[A/G]TCAAGTGCCCAACAGTTGAGCACT[A/G]TGG[C/T]GTGG
TCAGGTG[A/G]CTCTACCACTAAACCCAGGGGGTGGGTTTTCCCAAACAATGGCCAGCCTCTGAGAATTGGTG
TTCCAAATAAACCAAG[C/T]TTCAAGGAATTTGTGGCAAGTGGCAAAGGTCCTGATAAC[A/G]TGACAGGTT
ATTGCATTGATATATTCAATGCAGCAGTTAAACTGCTTCCTTACCCTGTTCCTTCCAAATTCATATCAATCGG[
C/T]GATGGTATACATAATCCTAAATATGATGACATCATTAATATGGTTGCAAACAA[G/T]ACCATTGA[C/T
]GTAGCTG[C/T]AGG[C/T]GACTTCGCTATTATCAAAAATAGAACAAGGATTGC[C/A]GAATTCAC[A/G]
CAGCCCTATATTGAGTCACGGATGGTGATAGTAGCGCCAGTGAAACAGTCAACTTCAAGTGCATGGGCTTTCTT
TAA[A/G]CCATTCACATTAGAGATGTGGTGCGTAACTGGTGCTCTTTTTGTCTTTGTGGGAATAGTTGTTTGG
ATTCTGGAACATCGGACTAATGAGGAGTTCCGAGGCAC[A/T]CCACAGCAACAAGTCC[G/T]AACAATATTT
TGGTTTGCTTTCTCAACAATGTTCTTTGCACAC[C/A]GAGAAAACACCGTAAGTGGTCTTGGGCG[C/T]TTC
GT[C/T]CTGATCATATGGTTATTTGTGGTGCTGATCATCAACTCAAGTTACACTGCTAGTTTGACGTCAATCC
TCACAGTCCA[A/G]CAGCTTGTAACCGGAGT[A/T]ACTGGACTGGACAATTTGATTGCAAGCACTGTACCCA
TTGGACACCC[A/G]GCTGGAAAATTTATC[C/A]GAAATTATCTGATTGAAGAGCTGAAT[A/G]TTCATGAA
TCCCGCCTGGTGCCA[C/T]TGAACACGATCCAGGACTATGCGGATGCCCTTAACCGTGGACCAAAAGCTGGTG
GTGTTGCTGCAGTTATTGATGAAATGCCGTGTGTTGAGCT[C/A]TTCCTGTCATACCACTGTAACTTCAGAAT
AGTAGGTCAGGAGTT[C/T]AC[A/G]AAGGAGGGATGGGGATTTGCATTTCAG[C/A]GAGATTCTCC[A/G]
CTTGCTGCAGACATGTCAACGGCCATCCTTCAACTTTCAGAGA[C/G]TGG[C/G]CAGCTCCAGAGAATTCAC
GACGAGTGGTTGACGCGGCCAAGTTGCAGCTCTGATGATAGTGGGTTGGGACCAAGCAG[A/G]CT[A/G]GAT
CTTGGAAGCTTCTGGGGTCTTTTCCTGCTGTGTGCTATGATCTGCCTCTTCTCTCTTGGGCGTTCTTTGTAAA
AATAAGCTGCCAGTACAGCAGGTACTCCA[C/G][C/T]TCTGTGGCTGCTGGCGAATCCAG[C/T]GAAGCTT
CTCCTACCTCCCCTGCTGTTTCTGAAGTACACCC[A/G]ACGAAA[C/G]CAAAGCCAAGACGTCTTGATAGCT
TCAAAGATCTGATG[C/T]ATTTTGTTGACAAGAAGGAGGAAGATGTTAAAAA[A/G]GAAATGAAAC[A/G]G
AGATCAAGCGATAAAGATAATCATGG[C/T]GTGGGATCCTCAGATACACACTTTGTCTCTTCAGCATAG
```

FIG. 26

LpOs05g0152900

ATGG[C/G]ACCGGCGTCTACACGCGCGGCAGCGGCACTC[C/G]A[C/T]G[A/G]CGTGACTTTAGACAACA
[C/A]CGACGCCCTCGACTGC[C/G]GC[C/A][C/T]TTGCTGCCTACC[C/A]CTCAAGCCGCCCATCTTCC
AGTGTAAGGTGGGGCACGTGGTATGCTC[C/G][C/A]CGTGC[C/A]GA[C/G]ACAAGCTGGGGGCGGCTC[
A/G]GAGGTGCCATGTGTGTCGCACG[A/G]CGAC[C/T]TCCGGCGGATACCA[C/T]CGGAACCA[C/T]GA
CATGGAGAAGCTGCTGGA[A/G]TC[C/G]AT[C/T]C[A/G]GGTGCCTTGCTCCAACGCCGCCTACGGCTG[
C/T]GC[C/T]GCCAAGCCGGTCTACTA[C/T]GAC[A/G]GGGACACCCACCTCCGGTTGTTCTGCCAGCACG
CGCCCTGCCACTGCAATATAGAAGCATGTGGCTTCGTTGGCTCGACATTATCGGCGCTCCTTGACCACGTCTTC
GCCGTGCATGTTGAATAA

FIG. 27

LpOs05g0153200

ATGGACTATACCTCGGATGGAGATTCTGAGCTTGAAGCTTATGGGTCAGACACTTATGCACTTCTGCTGTCAGG
AGATATACAAGCTGATGAATGATGAGGGCTTGTACAAATGCCCCTTTTGTTCGGATGAAAAGGATGACTATAACA
AATATGATTTACTGCAGCATGCCCTTGGTGTGGGGGCTGCACATGATCAGCAAGTGAAAGAGAAGGTAGACCAT
CCACCCCTTGCCAACCATTTGAAGGATGATGAACCAGCTAAATCCCATAGCCCACTCCTGCACCCAATTGTTAT
AGATCCACAGCCTCCTCAACATAACAGAGATGACCTGTTTGTCTGGCCCTGGATGGGTATCATAGTCA[A/G]T
ATGCCT[C/T]CTGA[A/G]TATGTTGGAAAAAG[C/T][C/G]CAAACCGGCT[C/G]AAGG[A/G]GCATTT
CTCACGTTT[C/T]TATCC[C/T]GTGAAAGTGCACCATGT[C/G]TACAGTAAAG[C/G]TCGCCCTACAGGA
AATGCTATTGTT[C/G]AGTTTGGGAAGGACTTGGTTGGTTTTAGAAATGCACTA[A/G]CATTTGA[C/G]AA
TCAATTTGAGAAGGAAGGG[C/T]ATGGGAAAAT[A/G][C/G]GCTGGCAGGAAAAA[C/G]AGCATGGAGGG
CCAGAGCCTTTTGGATGGATCGCTAGAG[C/G]AGAC[A/G]ATTACAAT[A/G]CTCCAGGAGCAA[C/T]AG
GGGACTTTCTAAGAAAAAATGGTGATCTGAAGACGGCTGACGGTGTTGAGGATGAAGAAACAATGAAAAATAAC
AAACTTGTGGCCAGTTTATCTTTTAAAGTTATTGAAACTGATATGCATATAC[C/A]AGAACT[G/T]AAATCT
GTGTATCAGGA[C/G]AGAACTGC[C/A]TCACTGAAAAGAATGATGGAGCAGAGGGAACAGCAGCTACAGTCA
TACAATCAAGAAATCCAAAAGATGCAACAGCTTTCTGTTGAACA[C/T]ACAA[A/G]AAC[A/G]ATTGTTGA
CGAGAACAAGAAGCTA[C/A]GCCTGGATCTTCAGTCTATGACGCATGAGCTTGATGCAAGGTCCAAACAAATT
GATGAGTTGGC[C/T]GCACAGACTGATTGTGACAGAA[A/G]AAACCTTGAATTGGAGAAGCAAAGGAATGC[
C/A]ATGAAGTTCAATCATCTTACGCTGGCAGAAC[A/G]GGAGTATCAGAAAGCTGATGAAAATGTTCTAAAG
CTTGTCGAACAACACAAGAGAGAAAAAGAAACTGCTTTAAA[C/A]AATATTAAGAA[A/G]TTGAACGAAAAG
CTGCATCTGAC[A/G]CA[C/T]AAACTTCAA[C/T]TGGATATAAAGCACCTGAC[A/G]GGAAAATTGGAAG
TGATAAAGCTCACACCAGGCAATGAAACTTCAGAAT[C/T]GGGGAAAAGAATAGCGGAACTGACAGAGGAGCT
GCGTGATAAGATCGAGGAGATGGATTATACAGAAAACTACAACCAAGATCTAATCGTACAAGA[A/G]AAAAAG
ACTGCTGTTGAGTTGCAAGAAGCTCGGAAACTGGCGATAGATGCAATACAGCGTTTTCCTGGCCAGAC[C/A]A
[C/T]TG[A/G]C[C/A]AAGCACACAT[C/A]GGCAT[C/G]AAGATGATTGGTGAGCTTGA[C/A]TTGAAA
GCATTTTCAAATGTG[C/T]GCAGGCAAAAATTTCCAAA[A/G]GATGA[C/T]GC[C/T]GAAGTTGAAAGTG
TTAAGCTTTGTTCAAAGTGGCAGAATGAAATTAG[C/G]AATCCAAACTG[C/G]CATCCTTTTGTGGCTGCTA
TG[G/T]TGAA[C/T]GGAAAA[C/G]AGTCGGAAGTGATCAGGGAGGATGACAAGAAGCTCCAGGAACTGAAA
GAGGAGTACGCTGAGGAAGCCTATGCTGCAGTTACGACGGCGCTGACCGAGCTCAATGAGCACAGTAGCAGCGG
CAGCAGGGTTCCTTTCCCCGAGATGTGGAACTACAAGGAGGGGAGGAAAGCGAAAACAAAGGAAATTGTCCAGC
ATGTCATCAAGCTGGCCAAGGCGAGCAAAAGGGGGCGTTGA

FIG. 28

LpOs04g0645500

ATGGACAGGGCGCGAGGTAGCGATGAAATGATACCAGGGGTATTTTTCGTCGGGCATGCGTGTCTGGAGGTGGC
CGCCCCCGCCGGTAGGACGTTTGACCTGGGGACGCCGGATCTGGAGGCTACTGACCGGATCTTGAGGACGGCGC
CGCCGCCGGAACCGGAGGCTACCGGTCGGACCTGCAGGGGCGACGCCGGGCCTGAAGCAGACGTAGATGTGGCC
GGCCGAGCCCTGGCCGTGGTTGAGCGCGACGGCGGCGCACGACCCGGCCACCGGCCGCGCGCTCACCGGCTCCTG
GCTATGGGACTC[C/G]GCG[C/A]TCGTCCTCACCA[A/G][C/T]C[A/G]CCTCGC[C/T]TC[A/G]GC[
C/T]G[A/T][A/G]CCCA[A/G][C/T]C[C/A]G[C/G]TCCT[C/G]GG[C/T]GCC[A/G]CCG[C/T]G
[C/G]TCGAGCT[C/T]GG[C/T]G[C/T][C/A]GG[C/T]ACGGGCCT[C/T]CC[A/G]GGCATCGC[A/G
]GCCGT[C/T]GC[A/T]TGCCT[C/T]GGCGCCGCGCG[C/G]TG[C/T]GTGCTCA[C/T]GGA[C/T]GTG
C[A/G][A/G][C/G]C[G/T]CT[C/T]CTGCCGGGCCT[C/T]AG[A/G]GC[C/G]AAC[A/G]CCGAGGC
[C/G]AACGG[A/G]CTCGACCTCG[C/A]C[A/G]C[C/G]G[C/T]G[C/T]AGG[C/T]GGACGTGCG[G/
T]GAGCTGCG[C/G]TGGGGGGAGGAG[G/T]A[A/T]GA[C/T][C/A]TGGT[A/G][C/A]TGCTCGATCG
TGAG[C/G]TC[C/G]C[A/G]TGCGT[G/T]GACGTGGTGCTCATGTCGGACGTCTTCTACGACCCGGAGGAG
ATGCCGGCAATGGCTACCACGCTGCGGCGGCTGTGGCGGACAGGCACGGTGTGTTGGGCGGCGAGCGAGGTGCG
GTGCGGCGTGCAGGACTGCGTGGACGTGCTGCGGGAAGAAGGCTTCGACGTGGCCGAGGTCGACAGGGTCACCA
GGCCGCTGCTGCGCGCCCCCTCGCAGAACGCCGACTTCGCCGTGTATCGCATCGAATTACGGCGGTCTCGAGAG
GGCTGA

FIG. 29

LpOs04g0645600

ATGGGTTCCAG[C/T]CT[C/G]AAGTACCGCGCCGG[A/G]CTCGTCCTCATCGGCGCCGTCGTGCTCATATG
GGT[C/A]ACCTTCCGCCGAGGTCACGCAGGAGAT[A/T]TTCGCTGACTA[C/T]AAGCAACC[A/G]TT[C/T
]GCGATCACTTACTTCGG[A/G]GCCTCCCTTATGGTCAT[C/T]TA[C/T]AT[C/T]CCC[C/T]TGGC[A/
G]TTTCT[A/G]AAGGATTTC[A/T]TATACAAATTG[C/T]TGAGAAGGCA[G/T]TCTGGAAGCAGCAGAGC
[A/G]TCAAA[A/G]GTCG[C/T]GAGCAAATCTTCCTTTGG[C/T][A/G]GCAGCGCTCCTCTGAAGA[A/G
][C/T]GG[C/T]GAATT[C/T]GAGAAGATGCTGGAAATGGA[A/G]CC[G/T]CAGAA[A/G]ACCGTGGT[
C/G]ATA[A/G]ATTTTAC[C/T]GA[C/T]GT[C/G][A/G]AC[C/A]TCCCTGT[A/G][C/A]TAGAAGA
GGC[A/G]AA[A/G]CC[A/G]CT[G/T]AT[C/T]TGTGGAATCGG[A/T]GA[A/G]TT[C/T]GGTGATGA
TGTTCT[C/G]AAGGAGCAACA[A/G]CTTTC[C/A]ACCAAGGAGATTGCAATTTACGGATT[A/G]TATCTT
TG[C/T]CCCAT[A/T]TGGTTTGTCACAGAGTATTTATCAAATGCAGCCCTTGCAAGAACAAGTGTTGCCAGT
ACTAC[G/T]CTACTATCTTCAACTTCGGGACTCTTCACACT[C/T]TTCATTAGTGTGCTCCTTGGCCAAGAT
TCCAT[A/T]AATGC[C/T]GCCAAAGTTAT[A/T]GCTGTTTTTGTTAGCATGGCTGGTGTAGCAATGAC[A/
T]ACTATGGGCCAGACTTGGGCAAC[A/T]GATGAATC[A/T]GAAGTAAGCAAT[G/T]CAGGAA[C/T]T[C
/T]AT[C/T]G[C/T]CTTGCTAACC[A/G]TCTAATTC[A/T]TAAGC[C/A]T[C/T]AC[A/T]ACTGCAG
GGCCACACAGAGGACTCTTCTAGGTGATATGTTTGGTCTTCTGTCAGCTGT[G/T]TC[A/G]TATGGTCTCTT
[C/T]ACTGTCCT[C/T]CTCAAAAAGTTTGCTGG[C/A]GG[A/G]GAAGGATC[A/T]GAAAAGGTTGATGT
CCA[A/G]AAA[C/T]T[C/G]TT[C/T]GGCTTTCTCGGACTTTT[C/T]ACTCT[C/T]T[G/T]TCTTCTC
TGGTGGCT[C/T]GTCTGGCC[A/G][C/T]TAAC[A/T]GC[A/G]CTAGG[C/G]AT[C/T]GAGCCAAAGT
TTACAATGCC[C/T]CACTCAGC[C/T]AAAGTGGATGAAGT[G/T]GT[G/T]CTGGC[A/T]AATGG[C/T]
CT[A/T]ATTCGGAGTGTGCTATCAGACTATTTCTGGGCTCT[A/G]TC[C/T]GTTGTTTGGACTAA[C/T]C
CC[C/T]TGGTGGCCACCTTAGGCATGTCACTCACAATTCCACTAGCGATGGTTGCTGACATGGTCATCCATGG
TCGACATTATTCAGCAGTCTACATTATTGGTTCTCTACAGGTATTCTCTGGCTTTGTCATTGCCAATCTTGCCG
ATCGCTTTTCACGTTTTCTGGGTCTATAG

FIG. 30

Lp04g0647300

ATGACCAGCCCATCCCCGCCGCCGCCCTGCCCTCACCTCGCCGCGCACCGCCTCACCTCGCGCCCGCTCCGCTT
CCCCCCCCGCTCCCTCCGCCTGCGTCCGCTCGGCCGCCCCGAGATCCGCCGCCACGCGCCGCGAGGTGCCCCGCT
GCTCCCCCTGCGCGTCCTCCTCCCCGCCCCCCGCCCGCCTCTACGCCTGCCTCTCCTGCGCCTCCGTCTTCTGC
CCCTCGCACGCCGCCTCCCACGCCTCCTCCTCCCCGGGCCACCAGATCGCGGTCGACGTGGACCGCGCCGAGCT
CTTCTGCGCCGCCTGCGGGGACCAGGTCTACGACCCGGACTTCGACCACGCCGTCGTCCTCGCCCAGTCCACCG
CGCTCAGCCCCCCATCCACCTCCACCCCCTCACCCGCTCCCCGCAAGCGCCGCCGCGTCGACTACCGCGCCTGG
GCGCCAGATCCGGCCGAATCCGCGCTGGTCAGCGCGGCCGCCGATCCCACCACTTCAGCGTCCACAACCGATCC
AGCGGGCCTGCGCGGGCTAAACAACCTCGGCAACACCTGCTTCATGAACTCCGTGCTCCAGGCGCTCCTCCACG
CGCCGCCGCTCCGGAACTACTTCCTCGGCGATCGCCACAACCGATTCCTCTGCCCGCGCCGCACGCCCATGAGG
CACCGCGCGACCGATGCGGACGCCAAGGCCGCCTGCCTCGCCTGCGATCTCGACGAGATCTACTCGGCCACCTT
CTCTGGGAGCGTACGCCATACAGCCCCGCCAAGTTCCTCTATAGGTCCGGATCTCAA[C/G]CTC[G/T][A/
T]TTTGCATT[C/G][C/G]TT[C/G]ATG[C/T]C[A/G]CG[C/G]TGTCATTTC[A/G]G[C/A]A[A/G]
CCTGCTGTTCT[A/T]TTTTAT[A/G]CT[G/T]GCTGGTGGCAGCATGCAACAAACCTTGCAAGCTA[C/T]G
AGCAACAGGATGC[C/A]CATGAATTTTTTATCTCCATCCTTGA[C/T]CATATTCATGAAAATATAAAGGATG
ATGAGCACAAATCACATGAACAAGGCCA[C/T]GGAGACTGTTGCATTGCACA[C/T]CGGGT[A/G]TTTTCT
GGTATCCTGAGATCAGATGTCATCTGCACAAATTGTGGGTTCTCATCCACAACTTTTGAACCTTGCATGGACTT
[C/T]TCTTTAGA[C/T][C/T]TGGATGCTGGATGTAA[C/T][A/G][G/T]TTCTCGTGGTGTTGCAAACC
CAAAAG[C/T]ACGCAATGGAGAGAGGAACTTAG[C/T]T[A/G]GCATGAATCCCAAGGTATCATCAACACTC
ATGAGATGTTTGGAGCGGTTTACCAGGGCTGAGAGGCTAGATGCTGACCAGAAGTTCTTCTGTGAACGTTGCAA
GGAGAGGCAACAGTCCCTTAAGCAAATGTCCATTCGGAGGCTTCCACTAGTTTCCTGCTTTCACATCAAGAGAT
TTCAGCATTCCACACTTAAGAAGATGTCAAGGAAGGTTGATCACTCTTTGCACTTCCCTTTTTCTCTTCACATC
GCACCTTACCTGTC[A/G]TCCTCAATTCTCAGAAG[C/T]AGATA[C/T]GGGAACCGCATATTCCATCAGA
[A/T][G/T]CCAT[A/T]GATTCAGAAGCA[A/G]TT[C/T]C[A/G]GAATT[G/T]TCTTCAGAATTTGAA
ATATTTGC[A/G]GTGATCAC[A/T]CATAGTGGTAAG[C/T]TAGATGCTGGCCACTA[C/T]GT[C/G][A/
G]CTTATCTCAGGTTAAACAATCAGTGGTACAGATGCGA[C/T]GATGCATGGGTAACCAGAGTTGA[C/T]GA
GCATACTGTCAGGACTTCCCAAGCATATATGCTCTTCTATGTGCAGAAGAC[A/G]CTTT[A/T]CTATAAAGC
TTG[C/T]GAAA[A/G]GC[C/T]AGCTGCAGTCTGA

FIG. 31

Lpos03g0193400

ATGGGCAGGCGAGGCGGCGTGTTGTTTGTGGTGGGGGGAGGAGACGGCGTGGCGAGGAGGCGGGATGGGGAGGC
GGCGCCGCGAGGAGGAGGGGATGGGGGCGCCGGGGACGGATGCGTGCTGGGGAGGGGGAGCGATGGGTTTCTGC
GAGAGGAGAATAGTGGAGGCGGGATCGCTAATTACATGGTGGTAGACTACTACCTGTATGACTACGAGTACGCC
GAGCCGCCGCGCGTGACCAGCCTGCAGAACGCCGTTCCCCAGAGGACCTTCAGCGACTTCGGAGATGACGTCTA
CTTCGTCGCCGACAAACGGGGCTACGAGTCCGTCGTCCACTACCTCGCCGGCCAGTACCTCAACACCGACGACT
CCGGCAACGTCGCCGACCCCCGCCTGCAGCTCAACAAGGTGGTGCGAGAGATCTCCTACTCCTC[C/G]AG[C/
T]GGAGTC[A/G]C[C/G]GTCAAGACGGAGGACG[A/G]CTCAGTGTACC[A/G]GGCAGACTATCGTCAT[C
/G]GTCTCTGCCAGCTTGCCATCTCA[C/T]ACCCA[A/G]CA[C/G]ACCACTCT[A/G][C/G]TAA[C/T]
TACTCGATCATACTCTTGACA[C/T]TTGCTATGTCGATCGACCTGCA[A/G]GCATGGAA[A/G]ATCATCGC
CATCTAC[C/A]G[A/G]TT[C/T]GACATGGCAGT[C/G]TACACCAAGATCTTCCT[C/A]AA[A/G]TTCC
C[C/T]CGGAAGTTCTGGCCCACGGG[C/A]GA[C/A]GG[C/G]AAGCAGTTCTTCGT[C/G][C/T]ACGCC
AGCTC[C/T]AGGCGAGGCTACTA[C/T]GGGATGTGGCAGTC[C/G]TT[C/T]GAGGAGGAGTACCCGGG[A
/G]GC[C/T]AACGTGCT[C/G]CT[C/G]GTGACGGTGACGGACCA[A/G]GAGTCGCGGCGATCGAGCAGC
AGCCGCACAAC[A/G]C[C/G]AC[C/G]ATGGC[A/G]GAGGC[G/T]GTGGC[G/T]GTGCTGCG[C/G]AG
GATGTTCCCCG[A/G]CGAGGACGTCCC[C/A]GACGCCACCGA[C/T]ATCTACGTGCCC[C/A]G[C/G]TG
GTGGTCCAACCGCTTCTTCAAGGGCTCCTACTCCAACTGGCC[C/T]ATCGGCGTCAACCGCTACGAATA[C/T
]GACCAGCTTC[G/T]GGCGCCGGTGGG[A/G]CGGGTCTACTTCACT[G/T]GGGAGCACACCAG[C/A]GA[
A/G]CACTACAATGGCTATGTCCATGGAGGTTATCTTGCAGGCACGGATTCTGCTGACATTCTGATGAACAGTA
TCTTCAACAACGTGGAGTTTAAAGTCCGCGGCAAGTACCATGACCAGACCGCAGAGGCTAAATGA

FIG. 32

LpOs06g0607800

ATGGCCGAGGCCGACGATCCCGCGGCCGCCCGCCGACGCACCGTGGTCACCGACTACCGCAACAAGCTCCT[C/
G]AACTGCCGCGACCTGGAGACGAGGGTCCGCACAGAATTAGAACTTGACAGAGGA[A/T]A[G/T]AAGAGTG
ACTACCCAGTATCT[C/T]GATCAGCTAGGGAGAACCT[A/T]AAAAAGGCAAAGAAAGATTATGATAAAAC[A
/G]GAAGATGACTTGAAGTC[C/T]TTGCAGAGTGTGGGCCAAATCATTGG[G/T]GAAGTACTTCGGCCATTG
GACACTGAAAGATTTAT[C/T]GTCAA[A/G]GCCAG[C/T]AGTGGGCCAC[A/G]TTATGT[A/G]GTTGGC
TGCAG[A/G]AG[C/T]AAAGTTGACAAAGAAAAGCT[A/G]ACAGCTGGAACGCGGGTTGTTCTTGACA[C/T
]GACAACTTTAACCATTATG[C/A]G[C/A]ACTCTACC[A/G]CG[C/T]GAGG[C/T]TGATCCGGTGGTCT
ATAACATGCTACA[C/T]GAAGACCC[A/T]GGCAA[C/T]GTCAGTTA[C/T]TCAGCTGTAGGTGGATTATC
[A/G]GATCAAATAAGGGAACTGCGGGAGTCTATCGAGTTACCGCTTATGAATCCTGAACTCTTTCTCCGTGTT
GGGATTAAACCGCCAAAGGGTGTTCTGCTCTATGGCCCACCTGGAAC[G/T]GGGAAGACA[C/T]TGCTTGCT
ACAGCTAT[C/T]GCTAGCAACAT[C/T]GATGCAAACTTTTTAAA[A/G]AAGATTGTTTCAAGTGCTATCAT
TGACAAATATAT[C/T]GCTGA[A/G]AGTGCCCGTCTTATA[C/A]GAGAAATGTTCAACTATGCACGCGAGC
ATCAACCATG[C/T]ATTATTTTCATGGATGAAAT[C/T]GATGCCATTGGTGGCCGAAGATT[C/T]AG[C/T
]GAGGG[C/A]AC[C/T]AG[C/T]GC[A/T]GA[C/T]CG[G/T]GA[A/G]ATCCAACGGACATTGATGGAG
CTCCTAAATCAGTTAGATGGATT[C/T]GATGAGCTTGGGAAGGTCAAGATGAT[C/T]ATGGC[A/G]ACCAA
C[C/A]G[G/T]CCTGATCT[C/G]TTGGATCCTGCACTCCTTCGTCCTGGACGCTTGGACCGGAAGATAGAAA
T[C/T]CCATTGCC[A/G]AATGAGCA[A/G]TC[C/G]AG[A/G]A[C/T][A/G]GAGGT[C/G]CT[A/G]
AAAATCCA[C/T]CC[A/C]GC[C/T]GGTAT[C/T]GCCAAACATGGCGA[A/G]ATTGATTATGAGGCT[A/
G]TTGTTAAGCT[C/T]GCTGAGGGCTTCAA[C/T]GG[C/T]GCCGATTTGCGCAATGTCTGCACTGAAGCTG
GCATGGCTGCCAT[C/T]CG[A/G]GCAGAGCGTGACTACGTCATCCATGA[A/G]GACTTCATGAAGGCGGTG
CGAAAGCTGAATGATGCCAAGAAGCTCGAGTCTAGCGCCCACTACAGCGCAGACTTTGGCAAGGAATAA

FIG. 33

LpOs06g0607900

ATGACAAAGCTCAAGAGCGTGGCGTCCACGGTGGGGGCGGCGGAGGAGTGCGCGGGGAGCGCTCGGCAGATTGC
CCCGTCGCCGATGAAGCTGCTGGTGCGCGTCGTGGAGGCGCGGGGCCTGCTGGCGGTGCACGTCAACGGCACCA
GCGACCCCTTCGTCAAGCTGCAGCTCGGCAAGCGCCGGGCCAAGACCGCCGTCGTCAAGAAGAACCTCGCCCCC
GTCTGGGACGAGGAGTTCAGCTTCCTCGTCGGCGACGTCACCGAGGAGCTCGCCGTATCCGTGCTCAACGAGGA
CAAGTACTTCAGCAACGACCACCTCGG[C/A]AGGGTCAAGGTGCC[C/A]CTCTC[C/A]CAGGTCATGGACA
CCGACGGCCTCTCCCTCGG[C/T]ACCGCATGGTACCAGCTCCAGCCAAAGAGCAGCAAGTCCAAGAGGAAATG
CCC[C/T]CGGCAAATCTCC[C/T]TGCCGCATATCCTTGTC[C/T]ACACG[A/G]ACGCAC[A/G]TGTCCG[
A/G]AGAA[C/T]TGCA[C/A]CCTCTACC[A/G]CGCCCCAC[C/T]TC[A/G]GA[C/A]GGCGTATCATCC
AGTTCAGACAGGTC[A/G]ATCGGGACCAA[A/G]CG[C/T]GGAGCTCTGTCAACCACCAACAGCTACATTGA
CCT[C/G]TC[C/A]GC[C/T]GTGGCC[A/G]GCTTGGACCGAGG[A/G]TC[C/G]CAGAGCAGCTTCGA[A
/G]CG[A/C]TC[C/G]CC[A/G]GATAGCTTCGTGCA[C/G]CAGCC[A/G]CCC[C/A]GGAGCAGC[A/G]
TCGA[A/G]CA[A/G]GCAG[C/T]C[A/G]CCGAGCCTGG[A/G]ACG[G/T]CCGCTGAAAC[C/T]GA[G/
T][A/G]CG[A/G][C/T]G[A/G]CCAACAC[A/G]TC[A/G]TCGATGGT[A/G]GAGGTCTTGTC[G/T]C
GCTA[C/T]TTCTTTCGGAAACCTG[C/T]CGA[C/T]GC[C/T]G[C/T][G/T]GTG[C/G][C/T]TGC[A
/G]G[C/T]TGTCTC[C/T]GA[C/T]GCCGAGTCG[A/G]TGGTGGATCAGTC[C/G]CC[A/G]GAG[C/T]
CGAAAG[C/T][G/T]TGCTCTGAAGAACGTGAA[A/G]G[C/T]CCTGAGAA[C/T]CGC[A/G][C/T]GCC
ACCTGAG[A/T]C[A/G]AGCCTTGATGAGCTACT[A/G]AAAAT[C/T]ATGGAGTCCAAAGATCA[A/G]GG
C[G/T]CTGAAATGCCAGC[C/T]AA[A/G]CTGTC[A/T]AA[C/T]GGCGT[G/T]CTGGT[C/T]GA[C/T
]GAATC[C/T]TA[C/T]GT[C/T]A[C/G]TGCACC[A/G]GC[C/T]GGACTGAATA[C/G]GCT[C/A]TT
GTTTTCTCCAAATTCAGA[C/T]TTCTGGCCGGC[A/T]GTAGCAGA[A/G]CTTCAAGGAACAAGTGG[A/G]
TTTCAGATTGA[A/G][C/T]C[A/G]TGGAAGATCGATAGCAA[C/T]GATGGTTGTTTGCGAAGAACATT[A
/G]A[C/G]TTACATAAAAGC[A/T]GCGAGTAAG[C/T]TGGTTAAAGCT[G/T][G/T][C/G]AA[A/G]G
C[C/T]ACAGAAGAGCAGAA[A/G]TACTTGAA[A/G]GCAGCTGGGAATTCTTTTGCTGTT[C/T]TGTCTAT
TGTTAGCACTCCTGA[G/T]GT[C/T]CCTTG[C/T]GG[C/A]A[C/A][C/T]TGTTTCAAGATAGAGATA[
C/T]TGTACT[C/G]TATAAC[A/G]CCAGGTCC[C/G]CA[G/T]TTATC[A/T]TC[A/T]GAAGA[A/G]C
AAACGGCACACCTTACTCTAAGTTGGCGGAT[C/A]AACTTTGT[C/T]CAGAGCACAATGATAAAAGGAATGA
TTGAAAATGGGGCAAAACAAGGCATGTCAGAAGGTTATGCACAATTTTCTGAAGTACT[A/G]TCCCAAAAGTT
TAA[A/G][A/G]TAGCTGAGCT[C/T]GATGATGCTAATGCAA[A/G]CAAAGCAAAGATTTT[A/G]GCTTC
[A/G]CTGCATACACAAAAAGAACC[A/G]AGCTGGAGGCTGATTGTCCGCTTCCT[C/T]GGGA[A/G]CTTC
ACATTCATAGTCTCTGTTATCGT[A/G]GGG[C/A]TATATATTATA[A/G]CACACCTTCATT[A/G]TCAA
AGCCCAAAGCGATGAATGGCT[C/T]GAGTATTTGGCATTGACCTTCC[C/A]GATTCAATTGGAGAGGTCG
TGGTTTGTCCTGTGTTCATCCTTCAGGGACAGAATATCATGAAAGTAATGAAGCGCTTTT[C/T]GAATGCATG
GAAACAAAGAGGTAGTGATCATGGAGTCAAAGCTCATGG[A/G]GATGGTTGGATACTGACTGTTGCACTTATT
GAGGGCA[C/G]TGGTATA[A/G]TA[A/G][C/T]TG[G/T][C/T]G[A/G]TTCCTCTGGCTTA[C/T]TT
GATCTTTATGCTGTTTTTACTTGCAAT[A/G]CGAAGAGGAAAACAAGCTCAATTAAATTCCACACCTCTGATC
CAAAATGCAATGAGATATTCGAATTTGATGCAATGGATGATCCACCATCAAGGATGGATGGTGCTATTCATGAT
TCTAATCGATC[C/T]GATGGAGATCC[C/T][A/G]TTGGTCA[C/T]GCTGAAGT[A/G]AACTTTCTGA[C
/A][A/G]AGCAGTTTGTCAGATTTAACTGACATATGGGTTCCTCT[A/T]GATGGGAAGTGTGATCCAGCAAG
CAACCC[G/T]AAGCTACACTTA[C/A]GAAT[C/A]TT[C/T]TTGAACAA[C/T]TCAAGAGGAACTGAAGT
TGTCATGAATTACCTGTCAAAGATGGGGAAAGAAGTCGGTAAGAAGATAAATTTGCG[G/T]TCAGC[A/T]CA
AACAAATTC[C/A]GCATTCCGGAAGCTTTTTAACCTCCCTCCAGAAGAGTTTCTCATTGATGATTTCACCTGC
CATCTAAAACGGAAGATGCCACTGCAGGTTATCCCTC[C/A]TACACTGTCAATTGGCAG[C/T]CCATCCTTG
ATGGTCATCCTGA[A/G]AAAGGATAGAGGGTCAGAAGCAAAACATGGTGCCAAGGGAAC[C/A]GATAACAAT
GGAAGATTGAAGTTCCATTTTCAGTCCTTTGTTTCGTTCGGTGATGCTCACAGAATAATTATGGGGAT[C/T]T
GGAAAA[C/T]GCGGTCACCGGGTCCAGAACAGAAGGGGGAGATAAT[G/T]GAGGAG[A/T]CTGAAC[C/T]
[A/G]AAGAACTCCCCGC[C/T]GAAGAATC[A/G]GGGTCCTTATTTAGCCATGAAGATGT[C/T]AAAATG
TCTGAAATATTCTC[A/G]TCAGTT[C/A]TCTCTGTGGACAAATATATACCAG[C/A]GGCAAATCAAATCAA
CTACAAGTTTGACAAAGCATTGTCTCGATCTGGAGGAGAAGCAAGCACCACTCAACAGAAGTATGCCCTAGTGA
ACCAAGATGG[C/G]TGCGCCATTGAAGAGGTGATGACACTCCAAGGTGTTCTACTTG[C/G]GGACTACTTTA
GTTTTGACAAACCATTCTCAAGATATGGAGGAGAAGCAACCACCACTCAGCAGACGTATGCTCTAGTGAACCAA
GACGGCTGGGCCATTGAAGAGGTGATGACCCTCCAAGGTGTTCTACTTGGGGACTGCTTCACTCTCCA[G/T]C
TCCAGCT[A/G]AAGTATCATATGGCGAA[C/T]GT[A/G]CC[A/G][C/G]C[A/G]AAACCAAACACCTGC
AGTGTGCAGGTTTTGTTGGGGATTGCCTGGTTAAAGAGCACCAA[C/G]CA[A/G]CAAAAGAAGGTCACAAAA
AATATCATGTCGAATACCTC[A/T]AATAGATTGAAGGAGCT[C/A]TTTTCTGAAGT[C/T]GAAAGGATCT
TACGTCAAGAAACGGTACCCTTTTTAGCGCATCTATTGATCCTTACCGTTCTTTA[C/T]ATGAT[C/T]CTAA
TATCACGTAA

FIG. 34

LpOs04g0648500

ATGAAGAAGCTAGGAGGTGGAGGCATACCACAAGATGCAGGTTTATCAGATTTTCTGAAGAACAGGCTACAGAA
GATACCAAGGATTTCTGCCCCCACTCAGCTTTTCTTGGGTCCGCCCCTGCATAGAAGTAGAACCGTAGAAACAC
CATGTGGAGGCAAAATCCCTTCATCAGAGGAGTTTT[C/G][C/G]TTGAT[A/T]TTACCCCTTCTTGCTGTC
TCGCGTCTGTCCCGTACGAACTCTCTACGAACAGAGTCCGTCGAGT[C/T]ACC[C/T]GTGCCCGACGCCTTC
GC[C/T]G[C/T]CCTC[C/A]CC[A/G]CCGCCGACGCCGA[C/T]GAAG[C/T]CGGAACCAGCAGCTCC[A
/G]CCG[C/G]CG[C/G]CGGCGGCGCA[A/G][C/A]CGCATCAAATCCCAT[C/A]TCCCC[A/G]CGCTCC
AGCAAC[C/T]CTCTCCCCTCC[A/G]CCACCTCCGCCACAACCCCTCTCGAGCTGCCCGGCGTA[C/A]C[C/
T]C[C/T]CGCCGC[C/G]TCCGC[A/G]CGAAACCCTAAGATCCACCACACCC[A/G]CGG[C/T]GTCCTCC
ACCTCTACCGCTCCTCCCC[C/A]TCC[C/T]TGCCCGC[C/T]TCATCCTACGCCTCCGCCGTCGCCGTCGCC
G[C/T]CACCCCCTCCTC[C/T]TCCTCCTCCGGGCC[C/T][A/G]CC[C/G]CCCCACCGCTCCAAT[C/G]
CGA[C/G]TC[C/G]CT[A/G]CTCCCGTCATGGCGCGGCACGCGCCTCCTTGTGCTCGC[C/T]GTCCCTACC
CGCGTCTCGCC[C/G]GA[C/G]GACTTCGTCCG[C/T]TTTTGCGGCCCCTACGT[C/T]GA[G/T]CACGCC
TCCGAGATCCGTGTCATCAGCGACGA[C/T]GG[A/G]GTGGAGGACCG[C/G]TACAGC[G/T]TGCTTGTGG
AGTTTGAGGATCAAAAGAGTGC[C/T]GA[C/T]GGATTCTACCTGGACCTCAATGGCTGGAGGTTCTCGTCCT
CAGAGGTTGTAATA[G/T]TGCCA[A/G]TTTGG[C/T]GCCAGTTGGTAGAGGTGTGCCATGTTCTGTTTATA
GTTGCTGTGCAATACATGCCATCCGCTGTGCCACCAGTTGGATCTAC[C/T]GAGCTTCCGAC[A/T]TGTCCT
GTTTGCAT[A/T]GAAAGGTTGGATCAAGACATCAGTGGAATTGTGGCAACCAATTGTGACCATTCTTTCCAGT
GTTCATGCGTTTCAATGTGGGTCAGTTCATCTTGTCCGGTTTGTCAGTTTTG[C/T]CAGAAGCAGTCTGAAAC
TCCTACAAATCCTACATGTTCTGTTTGTCAGACCTCTGAAAACCT[C/T]TGGATCTGTGTGATATGTGGTTTT
GTTGGATG[C/T]GGAAGGTATAAAGAAGGCCACTCAATTAGGCACTGGAAAGA[C/T]ACTCAGCA[C/T]TG
CTATTCTCT[C/T]GATTTGGAAACTCAACGTGTTTGGGATTATGTCGGTGACAGTTATGTTCATCGTCTTAAT
CACTCGAAAAGCGATGCAAAACATTCTAAGCTCAGGTCAAAGTGTGAATTTTCTGGGGACAACGATGACT[C/T
]GGATATGGTGGAGTTATGTTTAGCAGCAAAACTGATACAATCGTGGATGAATACAACCGTCTTCTTGCAAGC
CAACTTGAAACTCAGAGAGAGTATTACGAGGCTCTTCTGTCAGACGCTAAGAAAGATAGGGAACACATTTCTGT
TGCTGTGGATAAAGCTGTAAATGATAAGCTTCAAGAGATGCAACTTAAGCTTGAAAATACTATGTTGGAGAAAA
AGAAAGTTGCAGAAATGAATGAAAAACTCATGAAGAGCCAGGATATATGGTCCAAGACAGTAAAAGGAATAGAG
GAAAGGGAGAGAGCGCAGTTGAGGCTGAAGGATGATACAATTCTTGACCTGGAAGAACAGATTAAAGACTTCAA
GTACTCGATTAAGTTGCAAAAATCGATAGAGAAGAGTACACATGCTGATGATCTCAAAGGAGGTATGCTGGTGC
CACTGGCCATGGAATCAGAATCTGGAAAGGGTGCAGAGTTTGAGCATTATGTCAACATGTGTAAAAAGATCAT
GAGGCACCATACCAAAAAAATTTATTACCATCTAGGAAAAACTCTGACTCAATGGAAAAATTACTCATCCCACC
AAAAACCACACCACCAAGCTTGTTGTTTGATACCCTCAAGGTCAAGAGCATGGGATAA

FIG. 35

LpOs04g0648600

ATGTCGA[A/G]GCTGACCGTGGGGGT[A/G][A/T]GCA[C/T]CATGGTGGCGCTCAG[C/T]CTGGCCGTC
TTC[C/T]TCACCATCGTC[A/G]TCCTCCTCCT[C/G]GCCGACCT[C/A]TTCTGCTCCACCTCCGCC[G/
T]CCGCCG[C/A]CT[C/T]CGCGCTGACGC[C/G]G[C/A][C/G]ATGGC[A/G]CCGCACAAGAGGC[A/
G]AAGC[A/T][C/T]GGCG[C/T]CCCGG[C/T]GTCGTCCCC[A/G]CCG[C/T]ACACC[A/G]CCGACGA
[C/T]GCGTC[C/G]GTGGCCACCACCACCAC[C/G]ACGGCGACGCACGAGGCGCTCTCCAGCACCC[C/T]G
CCCTTCTACTAC[A/G]CGCACGG[C/T]GTCATGTGC[A/G]CGCCCACCCGCAA[G/T]GACCTCCTCCTCG
CCATCCCC[A/G]AGCT[C/G]GAGGCC[A/G]CCGTG[C/T]GGAAGTGGTCTCCCGCG[C/T]GCCGCTCCT
CG[C/A]CGTCGCC[G/T]TCGCC[A/G]CC[G/T][C/T]GGTCCGAGCCCACCGCCC[A/G]CGA[A/G]TC
CT[C/T]CTCC[C/T]CCGC[G/T]TACAGC[A/G]ACGGCTTCCTGCGCA[C/T]CTCCAACCCCGT[A/G]T
ACGAGCGGGCGC[C/T]A[C/T]GGCCG[C/G][C/G]CC[C/G]GGCG[A/G]G[C/T]ACGAAGAAGACA[
C/T]GC[C/T]GTTCGACACGCCTG[A/G]C[A/G]C[A/G]TCGCC[A/G]TCCCCGAATGGGATTACAGAGG
AAGAGGGGGCTTTTGGACGTGTCAACCACACGCATCAGGGAGCCCGATCATGA

FIG. 36

LpOs04g0648900

ATGGCGCCTCTTGCCGC[C/G]GC[A/G]GC[C/G]GC[C/G]GCGGTGGCGGC[C/G]AAGGAGGAGCTGGGC
GTGACGGTGGCC[A/G]TGGCGCCGCCGATGGCGCTGGCCCCGCTGAGCCAGCAGCA[G/T]CCGCGGCGG[C/
T]AGTACCGCGG[C/T]GTG[C/T]GCATGCG[C/G]AAGTGGGGCAAG[A/T]G[A/G]GTGGCGGAGATCC[
A/G]GGAGCCGCACAAG[C/T]G[C/T][A/T][C/T]GCG[C/T]ATCTGGCTCGGCTCCTAC[A/G]CCACG
CCCG[C/T][C/G]GCCGCCGCGCG[C/T][A/G]CCTACGA[C/T]ACGG[C/T]CGT[C/G]TTCTACCTG[
C/T]GCGGCCG[C/G]TCGGCCAGGCTCAACTTCCCCGACGAGATCTCCGCGCT[C/G]GCGCCGCT[C/G]TC
CCCGCC[G/T]CCCGAGGAGCTGGAGGC[C/G]GACGGCGGCGCGCTGTCGG[C/T]GGCGTCGATC[C/T]GG
AAGAAGGCCATCGAGGTCGGGTCCCGCGT[C/G]GAC[A/G]CGCT[C/G]CAGACCGG[C/G]ATGAC[C/G]
ATGGTCGCC[A/G]C[C/G]GCCGCCGCGCCG[A/G]CGAC[A/G]AACCA[C/G]CG[C/G]GAGCGGCAGAG
GCAGCA[C/G]CAC[A/G]C[A/G]CAGCAGCAGGC[G/T]GCGCG[C/T]GA[C/T]GAGGAGCTGCTCC[A/
T]GCTCCACCACCAGAAGCAGCAGC[A/G]GACGG[C/T]GTGGAACGGGCGGGCCAAGAACCCGGATCTCAAC
CAG[A/G]CGCCCGACCC[C/G]GACAGCTCCGACGCCGAGTGA

FIG. 37

LpOs05g0148600

MG[T/A]DLG[T/A]ELGALALKYTG[M/V]SLSVSDYDSIVAMNIFVALLCGCIVFGHLLEGNRWVNESTTAL
[S/I/G/V][K/M/Q/L]V[L/F]AVLSR[R/W]G[R/W]VA[S/W]LITGGVILLVTNGVNSRILVFSEDIFF
IYLLPPIIFNAGFQVKKKQFFRNFATITLFGAIGTL[I/V]SFVIIS[L/V]GAMGLFSKLDVDPLQLGDYLAI
GAIFSATDSVCTLQVLNQDETPLLYSLVFGEGVVNDATSVVLFNAI[Q/E]NIDLDHFDAFVLLQLIGKFLYLL
FTSTVLGIALLDLSGILTVFFCGIVMSHYTWHNVTESSRVTTKHTFATLSFIAELFLFLYVGMDALDIEKWRLA
[R/S]SRELIIWWAGLMRGAVSIALAYNKVFGLLTKPLINLLIPPRPSNTADGSSQSFLDPLLSSLLGSDLDIG
QYPPQTNL[Q/E]LLLTIQTRSVHRVWRKFDD

FIG. 38

LpOs01g0369700

MIGAVARIRHQLAYATHTFFDKEDFLYIHTPIITTSDCEGAGEMFQVTSLFSQAEKVDKELKENPAPSEAD[I/
V]EAAKLVVKGKGDAVAQLKA[T/A]KASKQEITAAVSELTK[E/A]KE[T/I/A/V]VLRLEERSKLKPGIPH
[K/R]DDGSIAFENDFFKRAAFLTVSGQLQVETYACALSSVYTFGPTFRAENSHTSRHLAEFWMVEPEIAYANL
HDDM[N/D]Y[A/S]ERY[I/V]KYLCKWLLDHCREDMEFMVKHVDKTAIERLELVSSTPFERISYTK[A/V]V
EILE[R/G]TGKKFENKVEWGIDLASEHE

FIG. 39

LpOs05g0149100

SRETRIGNTGRSIDRSARGPARRDGVSGAGGDAD[P/L]GQGP[E/G]EGDGV[P/L]QDA[G/C]VRG[S/G]
[I/V]HLRRRPAHAD[T/A]PDALG[P/L]ARRAAAVPN[T/P]DR[R/C]RPPRARTARAPPLR[T/A]LLRR
PRR[R/W]RG[T/A]RPRPGPFRRSASRRRASPPQLPGATPHERPEARGAPHLLQPHGRAGDR

FIG. 40

LpOs05c0149500

MRVTITGGG[K/T]RLHVDLYYA[R/C]VQSRA[P/L]FTV[_/W]SLLQLMRRH[P/R]GRVPD[V/L]DLMF
DC[T/M]DRPAINRTEH[T/S][A/G]EGAPPPPPLFRYCTTRDH[F/L]DIPFPDWSFWGWPETH[I/L]EPW
SREFKSIRQGAKKNWDEEARSGYQNSKLSSQCTHRYKIYAEGFAWSVSLKYILSCGSTALLIDP[M/L]YQDFF
SRGLEPRVNHLPVS[T/A]VGMCESIRDAVEWGNAHPDEAERVGRRGQRLMQDLAM[D/G]A

FIG. 41

LpOs05c0149600

MAGQGQDRKTIDLEEGWAYMEGGIGKLVNILEGKNEPQFNSENYMMLYTTIYNMCTQKPPNDYSQQLYDKYREA
FEKYIRDAVLPAIKEQHDEYMLKQL[K/N]VRWKNHKVMVRWLSRFFHYLDRYFITRRSLTPLKDVG[Y/F]IC
FRDLIFQEIKGKVKDAVLVLINQEREGEQIDKTLLKDVLDIFVEIGLTTMEFYENDFEDFLLKDTTEYYSVKAQ
NWIVEDSCPDYMIKAEECL[K/R]REKERV[S/G]HYLHINSEPKLLERVQNELLANYATQLLEKEHSGCYALL
RDDKVDDLKRMFSLFSKITRGLEPVSNMFKSHVTNEGTALVKQAEDSASNKKPEKKEMVGMQEQVFVWKIIALH
DKYVAYVTDCFHGHTLFHKALKEAFEVFCNKGVSGSSSAELLATFCDNILKKGCSEKLSDEAIEDALEKVVRLL
AYISDKDLFAEF[Y/C]RKKLARRLLFDKSANDEHERSILTKLKQQCGGQFTSKMEGMVTDLT[L/V]ARDHQT
KFEEFVAEHQEL[N/H]PG[I/V]DLAVTVLTTGFWPTYK[S/T]F[E/D]I[N/S]LP[A/S]EMVKCVEVFK
EFYQTRTKHRKLTWIYSLGTCNINAKFETKTIELIVTTYQAALLLLFNGVDRLSYSEIVTQLNLSDDDVVRLLH
SLSCAKYKILTKEPAGRSISPNDVFEFNSKFTDRMRRIKIPLPPVDEKKKVVEDVDKDRRYAIDASIVRIMKSR
KVMAHTQLVAECVEQLSRMFKPDFKAIKKRIEDLITRDYLERDKDNANTYRYLA

FIG. 42

LpOs05c0150400

MGFGRSRWTGSTALVINWRPLLYCRKEDINGHSGLRRDLPVASLLLRVDASMYKNQLQELAQRSCFNLPSYACI
REGPDHAPRFKATVEFNGEAFESPTFCSTLRLAEHAAAEVALKELSKRGPSSSLAAKVLDETGIYKNLLQET[A
/V/S/F]HRAGLKLPMYTTIRSGPGHTPMFTCTVELAGRIFTGNPGKTKKQAQKNAAMAAWSELKELPR[G/V]
G[K/E][A/V]ASSSSPSDEDN[E/G]EQEQVTVVRTLE[N/S]LNQKNE[G/V]KA[P/A]HQKEKQQRNNR[
P/S]QPRRS[Y/C]PKPS[A/V]SFYGSRLQNQ[T/S][Y/S]PNVAQ[K/E]QAM[H/Y]EMWHQVQPTCQK[
T/P][Q/H]FRMVPT[M/L]GNTRFPPPPTILSMYPPPRGQ[Y/F][T/A][M/V][Q/P]A[N/S]QDALAL[
I/L][Q/P]CFPE[P/A]AP[T/A]LPRYFS[P/S]YPASYVP[T/A]SPLP[T/A][A/S][S/I/G/V]NMM
HGRRQGC[D/A]E[T/M]VELP[N/D]APVF[A/G/S/C]RYTA[Q/P]D[Y/C]S[T/S]ALENVC[T/P]SE
VQQWPKNGKE[A/G][N/S/Y/C][T/P][K/E]SS[A/G]ATEE[K/E]NKAPQ[T/A]SSSST[T/I/M/A/
V]H[H/R]PSQ[K/N]LE[Q/P/E/A]NED[K/R][Q/E]SKK[F/A]AEQPLLGFYVVQRP[A/V]Q[Q/R]Q
[N/S]YP[S/I]P[M/V]QESEP[I/V]HRN[N/D]LPFR[T/I/M][A/V]TSP[D/G]PW[A/V/S/F][S/
L]DMQTPPRFGT[A/G][N/T]LANSA[S/G][L/F]LYQQRPPWLAAPVTVRTSIPVCSARPKAAVNSSPGAA
TRVRSTVQMLSRNNSEAQRNTRDMSDASTASSELSKLH1_

FIG. 43

LpOs05g0150500

GNIDICSKARNVFAYNGPVNFTVLERLVSRCRKLKTLKLNNAIPLDNVASLLRKAP[Q/H]I[I/V]ELGTGKF
SADYHPDLFAK[L/V]EAAFAGC[K/T]SLRRLSG[T/A]WDAVPDYL[P/S]AFY[G/C]VCE[S/G]LTSLN
LSYATV[Q/R]GPELIKFISRCKNL[Q/L]QLWVMDLIEDHGL[A/S][I/V]VAS[T/S]CSKLQELRVFPSD
PFGHN[A/G]GQV[F/L]LTERGLVDVSASCP[K/I/M]LESVLYFC[S/R]RMTNEAL[I/V][T/I/M]IAK
NRPNFTCFRL[A/G/S/C][I/L]LEPR[T/S]PDY[I/M]T[Q/R]Q[P/S]LDAGFSAIVESCKGLRRLS[I
/M/V]SGLL[T/S]DLVFKSIG[E/A]EADRLEMLS[I/L]AFAG[N/D]SDLGL[N/H][D/Y]ILSGCKSLK
KLEIRDCPFG[N/D]K[P/A]LLANAAKLETMRSLWMNSCSLTVGGCRLLALKMPHLTVEIINDPGETCPVESL
PFDSPVEKLYVYRTLAGPRSDTPDCVQIV_

FIG. 44

LpOs05g0151300

MAQS[S/G]SDAAPISTHPTEEEEVTVERTPEEE[E/A]ARLRYLEFVQQAAAQAVVLAAAAYAYAKQGAGPLR
PGVDHVEGTVKAVVGPVYDRYHA[I/M/V]PLDLLKFLDRKVDSVQELDRRVPPVVKEVPTYARSAAAEVHKT
GLVGTATGLAKSAIARAEPKARDLYTRYEPVAERKAAEAWAALNRLPLVPSVTRAVLPTAAQLSAKYNSAVLDG
AKRGNSVATYLPLVPTERIARVFSYPPTDAAATSAPEMQPIPTQ_

FIG. 45

LpOs05g0152400

MLRLTLPCPSTLLTWQFTLSWHRMTCRPPAQETSLTEWWTEARQRLAPATLLTLWMTWKHRNSCVFEGAQPLIN
GLISSIKDETILWAKASATGLGVVTDDLGCSPWVILNRRFIEYCILGWENLPRVLLMYFNNVVLPQEGYFHSVI
CNSVDFRKSTVNNDLRYKVWDEPPQTEPLFLNMAHYDEMVNSGQPFARRFQKKE[P/R]LL[N/D]KIDDKLLR
RPGIIGPVPGAWCSGRKGWFVDSCSQWSDVNVVKPGPQALKLQQYINRTLEEANSGAKSCRR

FIG. 46

LpOs06g0680500

MGAAELLSLCLVLAAVAWTEGQRPRAVKVGALFDYDSTIGRAAQLAIELAVDDVNADRSVLAGTKLDLITADTN
CSGFVGTVQALQLMEKNVVAVVGPQSSVTGHVISHFVNELHVPLLSFAATDPTLSASEYSYFLRSTVSDYFQM[
R/C]AIASIA[Y/S]YYQWKEVTAIFVDDDYGRGGVSALGDALATKRARISYKAVIP[P/L]DANKDVISDILF
KVNMMESRVLVVHVKPDTGLR[I/L]FSIANELQMM[T/S]GGYVWIVTDWLAAVLDSSKSGYPK[N/S]MSYM
QGLIALRQIIPDSAAKKKFISKWN[T/I][A/V]ARKRKIASGLNSYGFYAYDS[I/V]WIVAIAIDKFLNSGQ
[K/Q]TNFSADTRLHDSDTSITTLSTLKTFDGGEHLLQQLLLTNF[K/T/F/A]GL[T/A]GLVQFD[P/S]DR
KLVHPAYEILNIGGSVP[E/G/D]LIGYWSNYSGLSVAAPETLYQKPPNMSSSAQQLST[M/V][A/V]WSG[D
/G]STTKPRGWVFPKNGQPLRIGVPNKPSFKEFVASGKGPDK[M/V]TGYCIDIFNAAVKLLPYPVPSKFISIG
DGIIHNFKYDDIINMVAN[K/N]TIDVA[A/V]GDFAIIKNRTRIAEFTQPYIESGMVIVAPVKQSTSSAWAFFK
PFTLEMWCVTGALFVFVGIVVWILEHRTNEEFRGTPQQQV[R/L]TIFWFAFSTMFFAHRENTVSGLGRFVLII
WLFVVLIINSSYTASLTSILTVQQLVTGVTGLDNLIASTVPIGHPAGKFIRNYLIEELN[I/V]HESRLVPLNT
TQDYADALNRGPKAGGVAAVIDEMPCVRLFLSYHCNFRIVGQEFTKEGWGFAFCRDSPLAADMSTATLQLSF[T
/S]GQLQRIHDEWLTRPSCSSDDSGLGPSRLDLGSFWGLFLLCAMICLFSLGAFFVKISCQYSRYS[T/S]SVA
AGESSEASPTSPAVSEVHPTK[P/A]KPRRLDSFKDLM[H/Y]FVDKKEEDVKKEMK[Q/R]RSSDKDKHGVGS
SDTIIFVSSA

FIG. 47

LpOs05g0152900

M[A/G]PASTRAAAAL[H/D][D/G]VTLDN[N/T]DALDC[R/G][T/I/P/L]CCLPLKPPIFQCKVGHVVC
S[T/P]CR[H/D]KLGAA[Q/R]RCHVCRT[T/A]TSGGYHRNHDMEKLLESI[Q/R]VPCSNAAYGCAAKPVY
YD[R/G]DTHLRLFCQHAPCHCNIEACGFVGSTLSALLDHVFAVHVE_

FIG. 48

LpOs05g0153200

MDYTSDGDSELEAYGSDTYALLLSGDIQVMNDEGLYKCPFCSDEKDDYNKYDLLQEALGVGAAHDQQVKEKVDE
RALAKHLKDDEPAKSHSPLLQPIVIDPQPPQHNRDDLFVWPWMGIIV[N/S]MP[P/S]EYVGKS[P/A]KRLK
[E/G]HFSRFYPVKVHHVYSK[A/G]RPTGNAIV[Q/E]FGKDLVGFRNAL[T/A]F[D/E]NQFEKEG[H/Y]
GK[I/M][R/G]WQEK[Q/E]HGGPEPFGWIAR[A/G]D[N/D]YN[T/A]PGA[T/I]GDFLRKNGDLKTADG
VEDEETMKNNKLVASLSFKVIETDMHI[Q/P]ELKSVYQ[D/E]RTASLKRMMEQRECQLQSYNQEIQKMQQLS
VEHT[K/R]TIVDENKKL[S/R]LDLQSMTHELDARSKQIDELAAQTDCDR[K/R]NLELEKQRNAMKFNHLTL
AE[Q/R]EYQKADENVLKLVEQHKREKETAL[K/N]NIKKLNEKLELTEKLQLDIKHLTGKLEVIKLTPGNETS
E[S/L]GKRIAELTEELRDKIEEMDYTENYNQDLIVQEKKTAVELQEARKLAIDAIQRFPGQT[S/I][D/G][
K/Q]AHIG[I/M]KMIGEL[E/D]LKAFSNV[R/C]RQKFPKDDAEVESVKLCSKWQNEI[S/R]NPN[C/W]E
PFVAAM[V/L]NGK[Q/E]SEVIREDDKKLQELKEEYGEEAYAAVTTALTELNEHSSSGSRVPFPEMWNYKEGR
KAKTKEIVQHVIKLAKASKRGR_

FIG. 49

LpOs04g0645500

MDRGRGSDEMTPGVFFVGHACLEVAAPAGRTFDLGTPDLEATDRTLRTAPPPEPEATGRTCRGDAGPEADVDVA
GRALAVVERDGAEDPATGRALTGSWLWDSA[I/L]VLT[N/S][H/R]LASA[E/V]P[N/S][Q/P][L/V]L
GA[T/A][A/V][L/V]ELG[A/V]GTGLPGIAAVACLGAARCVL[T/M]DV[Q/R][P/A]LLPGLRAN[T/A
]EANGLDL[D/A][T/A][A/V][Q/_][A/V]DVRELRWGEE[E/D/_/Y]D[M/L]V[M/L]LDRE[L/V][
P/A]CVDVVLMSDVFYDPEEMPAMATTLRRLWRDGTVCWAASEVRCGVQDCVDVLREEGFDVAEVDRVTRPLLR
APSQNADFAVYRIELRRSREG_

FIG. 50

LpOs04g0645600

MGSSLKYRAGLVLIGAVVLIWVTSAEVTQEIFADYKQPFAITYFGASLMVIYIPLAFLKDF[I/L]YKLLRR[Q
/H]SGSSRASKV[A/V]SKSSFG[S/G]SAPLK[N/S]GEFEKMLEMEPQKTVVI[N/D]FTDV[N/D][I/L]
PV[I/L]EEAKPLICGIGEFGDDVLKEQQLSTKEIAIYGLYLCPIWFVTEYLSNAALARTSVASTTVLSSTSGL
FTLFISVLLGQDSINAAKVIAVFVSMAGVAMTTMGQTWAIDESEVSN[A/S]G[T/I][H/Y][R/C]LAN[H/
R]LI[H/L]K[H/P][H/Y][N/Y]CRATQRTLLGDMFGLLSAVSYGLFTVLLKKFAGGEGSEKVDVQK[L/F]
FGFLGLFTL[C/F]LLWWLVWPLTALGIEPKFTMPHSAKVDEVVLANGLIGSVLSDYFWALSVVWTNPLVATLG
MSLTIPLAMVADMVIHGRHYSAVYIIGSLQVFSGFVIANLADRFSRFLGL_

FIG. 51

LpOs04g0647300

MTSPSAPPPCPHLAAHRLTSRPLRFPRRCLRVRPLGRPEIRRDAREVPRCSPCASSSPPPARLYACLSCASVFC
PSHAASHASSSPGHQIAVDVDRAELFCAACGDQVYDPDFDHAVVLAQSTALSPPSTSTPSPAPRKRRRVDYRAW
APDPAESALVSAAADPTTSASTTDPAGLRGLNNLGNTCFMNSVLQALLEAPPLRNYFLGDRHNRFLCPRRTPMR
HRATDADAKAACLACDLDEIYSATFSGERTPYSPAKFLYRSGSQ[P/A][R/L]FA[F/L][L/V][H/D][A/
V][T/A][L/V]SF[Q/R][K/Q]PAVLFY[T/A][G/C]WWQHATNLASYEQQDAHEFFISILDEIHENIKDD
EHKSHEQGHGDCCIAHRVFSGILRSDVICTNCGFSSTTFEPCMDFSLDLDAGCN[S/I/G/V]SRGVAKPK[A/
V]RNGERKL[A/V][S/G]MNPKVSSTLMRCLERFTRAERLDADQKFFCERCKERQESLKQMSIRRLPLVSCFH
IKRFEHSTVKKMSRKVDHSLQFPFSLDMAPYLSSSILRSRYGNRIFPS[E/D][A/S]IDSEA[I/V][P/S]E
[L/F]SSEFEIFAVITHSGKLDAGHYV[T/A]YLRLNNQWYRCDDAWVTRVDEHTVRTSQAYMLFYVQKTL[Y/
F]YKACE[K/R][P/L]AAV_

FIG. 52

LpOs03g0193400

MGRRGGVLFVVGGGDGVARRRDGEAAPRGGGDGGAGDGCVLGRGSDGFLREENSGGGIANYMVVDYYLYDYEYA
EPPRVTSLQNAVPQRTFSDFGDDVYFVADKRGYESVVHYLAGQYLNTDDSGNVADPRLQLNKVVREISYSSSGV
[T/A]VKTED[D/G]SVY[Q/R]ADYRH[R/G]LCQLAIS[E/Y]P[T/A][H/D]HS[T/S/A/G]NYSIILL
T[L/F]AMSIDLQAWKIIAIYRFDMAVYTKIFLKFPRKFWPTG[E/D]GKQFFV[H/Y]ASSRRGYYGMWQSFE
EEYPGANVLLVTVTDQESRRIEQQPDN[T/A]TMAEAVAVLRRMFP[D/G]EDVPDATDIYVP[S/R]WWSNRF
FKGSYSNWPIGVNRYEYDQL[R/L]APVGRVYFT[G/W]EHT[R/S]EHYNGYVHGGYLAGTDSADILMNSIFN
NVEFKVRGKYHDQTAEAK_

FIG. 53

LpOs06g0607800

MAEADDAAAARRRTVVTDYRNKLLNCRELETRVRTELELDRG[K/N/_/Y]KSDYPVS[R/_]SARENLKKAKK
DYDKTEDDLKSLQSVGQIIGEVLRPLDIERFIVKASSGP[H/R]YVVGCRSKVDKEKLTAGTRVVLD[T/M]TT
LTIM[R/S]TLPRE[A/V]DPVVYKMLHEDPGNVSYSAVGGLSDQIRELRESIELPLMNPELFLRVGIKPPKGV
LLYGPPGTGKTLLARAIASNIDANFLKKIVSSAIIDKYIGESARLIREMFNYAREHQPCIIFMDEIDAIGGRRF
SKGTSADRETQRTLMFLLNQLDGFDELGKVKMIMATN[R/S]PDVLDPAILRPGRLDRKIEIPLPNEQSR[T/I
/M]EVLKIHAAGIAKHGEIDYEA[I/V]VKLAEGFNGADLRNVCTEAGMAAIRAERDYVIEEDFMKAVRKLNDA
KKLESSAHYSADFGKE_

FIG. 54

```
LpOs06g0607900 Inserted seq

MTKLKSVASTVGAAEECAGSARQIAPSPMKLLVRVVEARGLLAVHVNGTSDPFVKLQLGKRRAKTAVVKKNLAP
VWDEEFSFLVGDVTEELAVSVLNEDKYFSNDHLGRVKVPLSQVMDTDGLSLGTAWYQLQPKSSKSKRKCRGEIC
LRISLSTRTH[M/V]S[E/G]EL[Q/H]PLPRPTS[E/D]GVSSSSDRSIGTKRGALSTTNSYIDLSAVA[S/G
]LDRGSQSSFERSADSFV[D/E]QPPRSS[I/V]EQA[A/V][T/A]EPGT[A/S]AET[E/D][T/A][T/M/
A/V][T/A]NTSSMVEVLSRYFFRKP[A/V]DA[A/V]V[P/L/A/V]A[A/V]VSDAES[M/V]VDQSPE[P/
S]K[A/V]CSEERE[S/G]PENR[T/M/A/V]PPE[T/S]SLDELLKIMESKDQG[A/S]EMPAKLSNGVLVDE
SYV[T/S]APAGLN[T/R]LLFSPNSDFWPAVAELQGTSGFQIE[P/S]WKIDSNDGCLRRTL[T/S]YIKAAS
KLVKA[G/V/C/F/W/L]KATEEQKYLKAAGNSFAVLSIVSTP[E/D]VPCG[N/T]CFKIEILY[S/C]ITPG
P[Q/H]LSSEEQTAHLTVSWRINFVQSTMIKGMIENGAKQGMSEGYAQFSEVLSQKFK[I/V]AELDDANA[N/
S]KAKILASLHTQKEPSWRLIVRFLG[N/S]FTFIVSVIVG[I/L]YII[T/A]HLHLSKPKAMNGLEYFGIDL
PDSIGEVVVCAVLILQGQNIMKVMKRF[S/L]NAWKQRGSDHGVKAHGDGWILTVALIEG[T/S]GI[I/V][T
/I/A/V][G/V][D/G]SSGL[L/F]DLYAVFTCN[T/A]KRKTSSIKFHTSDPKWNEIFEFDAMDDPPSRMDV
AIHDSNRSDGDP[I/V]GHAEVNFL[K/T]SSLSDLTDIWVPLDGKCDPASNPKLHLRIFLNNSRGTEVVMNYL
SKMGKEVGKKINLRSAQTNSAFRKLFNLPPEEFLIDDFTCHLKRKMPLQVIP[H/P]TLSIGSPSLMVIL[K/R
]KDRGSEAKHGAKGTDNNGRLKFHFQSFVSFGDAHRIIMGIWK[T/M]RSPGPEQKGEI[M/I]EE[T/S]E[P
/L]KELPAEESGSLFSHEDVKMSEIFSSV[I/L]SVDKYIP[E/A]ANQINYKFDKALSRSGGEASTTQQKYAL
VNQDGWAIEEVMTLQGVLL[A/G]DYFSFDKPFSRYGGEATTTQQTYALVNQDGWAIEEVMTLQGVLLGDCFTL
[Q/H]LQLKYHMANVP[P/A]KPNTCSVQVLLGIAWLKST[N/K]QQKKVTKNIMSNTSNRLKELFSEVEKDLT
SRNGTLFSASIDPYRSL[H/Y]D[P/S]NIT_
```

FIG. 55

```
LpOs04g0648500

MKKLGGGGIPQDAGLSDFLKNRLQKIPRISAPTQLFLGPPLHRSRIVETPCGGKIPSSEEF[S/C/W]LILPLL
AVSRLSRTNSLRTESVE[S/L]PVPDAFA[A/V]L[T/P][T/A]ADADE[A/V]GTSSS[T/A][A/G][A/G
]GGA[N/T/D/A]ASNPTSPRSSN[P/S]LPS[T/A]TSATTPLELPGV[T/P][P/L]AASARNPKTHHT[H/
R]GVLHLYRSSPSLPASSYASAVAVA[A/V]TPSSSSSGP[T/A][P/A]PPLQ[S/C][D/E]SLLPSWRGTR
LLVLAVPTRVSP[D/E]DFVRFCGPYV[E/D]HASEIRVISDDGVEDRYS[V/L]LVEFEDQKSADGFYLDLNG
WRFSSSEVVI|V/L|P|I/V|W|R/C|QLVEVCHVLFIVAVQYMPSAVPPVGSTELPTCPVCIERLDQDISGIV
ATNCDHSFQCSCVSMWVSSSCPVCQFCQKQSETPTNPTCSVCQTSENLWICVICGFVGCGRYKEGHSIRHWKDT
QHCYSLDLETQRVWDYVGDSYVHRLNHSKSDAKHSKLRSKCEFSGDNDD[S/L]DMGGVMFSSKTDTIVDEYNR
LLASQLETQREYYEALLSDAKKDREHISVAVDKAVNDKLQEMQLKLENTMLEKKKVAEMNEKLMKSQDIWSKTV
KGIEEREKAQLRLKDD'TLLDLEEQIKDFKYSIKLQKSIEKSTHADDLKGGMLVPLAMESESGKGAEFEHYVNMC
KKDHEAPYQKNLLPSRKNSDSMEKLLIPPKTTPPSLLFDTLKVKSMG_
```

FIG. 56

```
LpOs04g0648600

MS[K/R]LTVGV[S/C][T/I]MVALSLAVF[L/F]TIV[I/V]LLLADLFCSHLR[R/L]RRLRADA[D/E/A
]MAPHKRPK[H/L]G[A/V]P[A/V]SSPP[H/Y]T[T/A]DDASVATTTTTATHEALSST[P/L]PFYY[T/A
]HGVMC[T/A]PTR[K/N]DLLLAIP[K/E]LEA[T/A]V[R/W]KWSPA[R/C]RSS[T/P]SPSPP[R/W]S
EPTA[H/R]ES[S/F]S[P/S]AYS[N/D]GFLR[T/I]SNPVYERGA[T/M]A[A/G]PG[E/G][E/Y]EED
[T/M][P/L]FDTP[D/G][T/A]SPSPNGITEEEGAFGRVNHTHQGARS_
```

FIG. 57

LpOs04g0648900

MAPLAAAAAAVAAKEELGVTVA[M/V]APPMALAPLSQQ[Q/H]PRR[Q/_]YRGV[R/C]MRKWGK[R/_/W]
VAEI[Q/R]EPEK[R/C][T/M/S/L]RIWLGSY[T/A]TP[A/V]AAAR[T/A]YDT[A/V]VFYL[R/C]GR
SARLNFPDEISALAPLSPPPEELEADGGALS[A/V]ASI[R/W]KKAIEVGSRVD[T/A]LQTGMTMVA[T/A]
AAAP[T/A]TN[H/Q]RERQRQ[H/Q]H[T/A]QQQAARDEELL[Q/L]LHHQKQQ[Q/R]T[A/V]WNGRAKN
PDLNQ[T/A]PDPDSSDAE_

FIG. 58

LpOs05g0148600

GGGGACAAGTTTGTACAAAAAAGCAGGCTGTGCAGCGTGACCCGGTCGTGCCCCTCTCTAGAGATAA
TGAGCATTGCATGTCTAAGTTATAAAAAATTACCACATATTTTTTTTGTCACACTTGTTTGAAGTGC
AGTTTATCTATCTTTATACATATATTTAAACTTTACTCTACGAATAATATAATCTATAGTACTACAA
TAATATCAGTGTTTTAGAGAATCATATAAATGAACAGTTAGACATGGTCTAAAGGACAATTGAGTAT
TTTGACAACAGGACTCTACAGTTTTATCTTTTTAGTGTGCATGTGTTCTCCTTTTTTTTGCAAATA
GCTTCACCTATATAATACTTCATCCATTTTATTAGTACATCCATTTAGGGTTTAGGGTTAATGGTTT
TTATAGACTAATTTTTTAGTACATCTATTTTATTCTATTTTAGCCTCTAAATTAAGAAAACTAAAA
CTCTATTTTAGTTTTTTTATTTAATAATTTAGATATAAAATAGAATAAAATAAAGTGACTAAAAATT
AAACAAATACCCTTTAAGAAATTAAAAAAACTAAGGAAACATTTTTCTTGTTTCGAGTAGATAATGC
CAGCCTGTTAAACGCCGTCGACGAGTCTAACGGACACCAACCAGCGAACCAGCAGCGTCGCGTCGGG
CCAAGCGAAGCAGACGGCACGGCATCTCTGTCGCTGCCTCTGGACCCCTCTCGAGAGTTCCGCTCCA
CCGTTGGACTTGCTCCGCTGTCGGCATCCAGAAATTGCGTGGCGGAGCGGCAGACGTGAGCCGGCAC
GGCAGGCGGCCTCCTCCTCCTCTCACGGCACGGCAGCTACGGGGATTCCTTTCCCACCGCTCCTTC
GCTTTCCCTTCCTCGCCCGCCGTAATAAATAGACACCCCCTCCACACCCTCTTTCCCCAACCTCGTG
TTGTTCGGAGCGCACACACACACAACCAGATCTCCCCAAATCCACCCGTCGGCACCTCCGCTTCAA
<u>G</u>GTACGCCGCTCGTCCTCCCCCCCCCCCCTCTCTACCTTCTCTAGATCGGCGTTCCGGTCCATGGT
**TAGGGCCCGGTAGTTCTACTTCTGTTCATGTTTGTGTTAGATCCGTGTTTGTGTTAGATCCGTGCTG
CTAGCGTTCGTACACGGATGCGACCTGTACGTCAGACACGTTCTGATTGCTAACTTGCCAGTGTTTC
TCTTTGGGGAATCCTGGGATGGCTCTAGCCGTTCCGCAGACGGGATCGATTTCATGATTTTTTTGT
TTCGTTGCATAGGGTTTGGTTTGCCCTTTTCCTTTATTTCAATATATGCCGTGCACTTGTTTGTCGG
GTCATCTTTTCATGCTTTTTTTTGTCTTGGTTGTGATGATGTGGTCTGGTTGGGCGGTCGTTCTAGA
TCGGAGTAGAATTCTGTTTCAAACTACCTGGTGGATTTATTAATTTTGGATCTGTATGTGTGTGCCA
TACATATTCATAGTTACGAATTGAAGATGATGGATGGAAATATCGATCTAGGATAGGTATACATGTT
GATGCGGGTTTTACTGATGCATATACAGAGATGCTTTTTGTTCGCTTGGTTGTGATGATGTGGTGTG
GTTGGGCGGTCGTTCATTCGTTCTAGATCGGAGTAGAATACTGTTTCAAACTACCTGGTGTATTTAT
TAATTTTGGAACTGTATGTGTGTGTCATACATCTTCATAGTTACGAGTTTAAGATGGATGGAAATAT
CGATCTAGGATAGGTATACATGTTGATGTGGGTTTTACTGATGCATATACATGATGGCATATGCAGC
ATCTATTCATATGCTCTAACCTTGAGTACCTATCTATTATAATAAACAAGTATGTTTTATAATTATT
TTGATCTTGATATACTTGGATGATGGCATATGCAGCAGCTATATGTGGATTTTTTAGCCCTGCCTT
CATACGCTATTTATTTGCTTGGTACTGTTTCTTTTGTCGATGCTCACCCTGTTGTTGGTGTTACTT
CTGCAGG<u>TCATGGTGTTTGCGGTTTTGTCTCGCTGGGGCCGGGTGGCATGGCTCATCACTGGAGGGG
TGATCCTGCTCGTCACCAATGGGGTCAATTCGCGCATTCTGGTCTTCAGCGAGGATATATTCTTCAT
CTACTTGCTCCCGCCCATCATCTTTAACGCTGGGTTTCAAGTAAAGAAAAAGCAATTCTTCCGCAAT
TTTGCAACAATTACTTTGTTTGGGGCTATTGGGACATTGATATCCTTTGTAATAATCAGCCTTGGTG
CCATGGGATTGTTCAGCAAACTTGATGTTGATCCACTCCAGCTTGGGGACTATCTTGCAATTGGTGC
TATCTTCTCAGCAACAGATTCTGTTTGCACCTTACAGGTGCTTAACCAGGATGAAACACCCCTACTC
TATAGTCTGGTTTTTGGTGAAGGTGTTGTTAATGATGCTACATCTGTTGTGCTATTCAATGCAATTC
AAAACATTGATCTTGATCATTTCGATGCGTTTGTTCTACTACAACTTATTGGAAAATTCCTCTACCT
ACTTTTCACCAGTACTGTTCTTGGAATAGCT</u>AAAGGTATGGATAGTGTATCTTCATACTGCATTTGT

FIG. 59

**TTAATTTGAAAATGGTTATCTAGTTGCCTAACAAAATATAGCTGGGATATCTTATAACACATGTGCA
GGTGACATGGAAAAAAATGCCTATTTTTCTATGCACTAACTATTCATCATGTGACATACTTCCCCAA
AAAACTAAATAAGCCAAATTTTCCAGCTTCCGAGTCCTGAAAAAGAGTAGTGTACCTGATACAATTT
ATAGAGTTTTTTTTTTCGAAAAGAAGGGATAGCCCTCATAGATAGAGTACTAACTAAAAGTCTACTT
TTACCAATTTCAGGTTTTTG**AGCTATTCCAAGAACAGTACTGGTGAAAAGTAGGTAGAGGAATTTTC
CAATAAGTTGTAGTAGAACAAACGCATCGAAATGATCAAGATCAATGTTTTGAATTGCATTGAATAG
CACAACAGATGTAGCATCATTAACAACACCTTCACCAAAAACCAGACTATAGAGTAGGGTGTTTCA
TCCTGGTTAAGCACCTGTAAGGTGCAAACAGAATCTGTTGCTGAGAAGATAGCACCAATTGCAAGAT
AGTCCCCAAGCTGGAGTGGATCAACATCAAGTTTGCTGAACAATCCCATGGCACCAAGGCTGATTAT
TACAAAGGATATCAATGTCCCAATAGCCCCAAACAAAGTAATTGTTGCAAAATTGCGGAAGAATTGC
TTTTTCTTTACTTGAAACCCAGCGTTAAAGATGATGGGCGGGAGCAAGTAGATGAAGAATATATCCT
CGCTGAAGACCAGAATGCGCGAATTGACCCCATTGGTGACGAGCAGGATCACCCCTCCAGTGATGAG
CCATGCCACCCGGCCCCAGCGAGACAAAACCGCAAACACCATGA***AGAAGGAGTGCGTCGAAGCAGAT
CGTTCAAACATTTGGCAATAAAGTTTCTTAAGATTGAATCCTGTTGCCGGTCTTGCGATGATTATCA
TATAATTTCTGTTGAATTACGTTAAGCATGTAATAATTAACATGTAATGCATGACGTTATTTATGAG
ATGGGTTTTTATGATTAGAGTCCCGCAATTATACATTTAATACGCGATAGAAAACAAAATATAGCGC
GCAAACTAGGATAAATTATCGCGCGCGGTGTCATCTATGTTACTAGATCGA*ACCCAGCTTTCTTGTA
CAAAGTGGT CCCC

FIG. 59 (cont)

LpOs01g0369700

GGGGACAAGTTTGTACAAAAAAGCAGGCTGTGCAGCGTGACCCGGTCGTGCCCCTCTCTAGAGATAA
TGAGCATTGCATGTCTAAGTTATAAAAAATTACCACATATTTTTTTGTCACACTTGTTTGAAGTGC
AGTTTATCTATCTTTATACATATATTTAAACTTTACTCTACGAATAATATAATCTATAGTACTACAA
TAATATCAGTGTTTTAGAGAATCATATAAATGAACAGTTAGACATGGTCTAAAGGACAATTGAGTAT
TTTGACAACAGGACTCTACAGTTTTATCTTTTTAGTGTGCATGTGTTCTCCTTTTTTTTGCAAATA
GCTTCACCTATATAATACTTCATCCATTTTATTAGTACATCCATTTAGGGTTTAGGGTTAATGGTTT
TTATAGACTAATTTTTTTAGTACATCTATTTTATTCTATTTTAGCCTCTAAATTAAGAAAACTAAAA
CTCTATTTTAGTTTTTTTATTTAATAATTTAGATATAAAATAGAATAAAATAAAGTGACTAAAAATT
AAACAAATACCCTTTAAGAAATTAAAAAAACTAAGGAAACATTTTCTTGTTTCGAGTAGATAATGC
CAGCCTGTTAAACGCCGTCGACGAGTCTAACGGACACCAACCAGCGAACCAGCAGCGTCGCGTCGGG
CCAAGCGAAGCAGACGGCACGGCATCTCTGTCGCTGCCTCTGGACCCCTCTCGAGAGTTCCGCTCCA
CCGTTGGACTTGCTCCGCTGTCGGCATCCAGAAATTGCGTGGCGGAGCGGCAGACGTGAGCCGGCAC
GGCAGGCGGCCTCCTCCTCCTCTCACGGCACGGCAGCTACGGGGGATTCCTTTCCCACCGCTCCTTC
GCTTTCCCTTCCTCGCCCGCCGTAATAAATAGACACCCCCTCCACACCCTCTTTCCCCAACCTCGTG
TTGTTCGGAGCGCACACACACACAACCAGATCTCCCCCAAATCCACCCGTCGGCACCTCCGCTTCAA
GGTACGCCGCTCGTCCTCCCCCCCCCCCCTCTCTACCTTCTCTAGATCGGCGTTCCGGTCCATGGT
TAGGGCCCGGTAGTTCTACTTCTGTTCATGTTTGTGTTAGATCCGTGTTTGTGTTAGATCCGTGCTG
CTAGCGTTCGTACACGGATGCGACCTGTACGTCAGACACGTTCTGATTGCTAACTTGCCAGTGTTTC
TCTTTGGGGAATCCTGGGATGGCTCTAGCCGTTCGCAGACGGGATCGATTTCATGATTTTTTTTGT
TTCGTTGCATAGGGTTTGGTTTGCCCTTTTCCTTTATTTCAATATATGCCGTGCACTTGTTTGTCGG
GTCATCTTTTCATGCTTTTTTTTGTCTTGGTTGTGATGATGTGGTCTGGTTGGCGGTCGTTCTAGA
TCGGAGTAGAATTCTGTTTCAAACTACCTGGTGGATTTATTAATTTTGGATCTGTATGTGTGTGCCA
TACATATTCATAGTTACGAATTGAAGATGATGGATGGAAATATCGATCTAGGATAGGTATACATGTT
GATGCGGGTTTTACTGATGCATATACAGAGATGCTTTTTGTTCGCTTGGTTGTGATGATGTGGTGTG
GTTGGGCGGTCGTTCATTCGTTCTAGATCGGAGTAGAATACTGTTTCAAACTACCTGGTGTATTTAT
TAATTTTGGAACTGTATGTGTGTGTCATACATCTTCATAGTTACGAGTTTAAGATGGATGGAAATAT
CGATCTAGGATAGGTATACATGTTGATGTGGGTTTTACTGATGCATATACATGATGGCATATGCAGC
ATCTATTCATATGCTCTAACCTTGAGTACCTATCTATTATAATAAACAAGTATGTTTTATAATTATT
TTGATCTTGATATACTTGGATGATGGCATATGCAGCAGCTATATGTGGATTTTTTTAGCCCTGCCTT
CATACGCTATTTATTTGCTTGGTACTGTTTCTTTTGTCGATGCTCACCCTGTTGTTTGGTGTTACTT
CTGCAGGGCGATTGTGAGGGTGCCGGTGAGATGTTCCAAGTCACCTCCTTGTTCAGCCAGGCTGAAA
AGGTTGACAAGGAGCTTAAGGAGAACCCTGCACCATCTGAAGCTGATGTTGAGGCTGCTAAGCTTGT
TGTCAAGGGAAAAGGAGATGCAGTTGCGCAACTTAAAGCAGCAAAAGCTAGCAAGCAAGAGATAACT
GCTGCTGTTTCGGAGCTTACAAAGGCAAAAGAGGTTGTCTTAAGGCTGGAAGAGAGGTCTAAGTTGA
AACCTGGAATTCCCCACAAAGATGATGGGTCCATTGCGTTTGAGAATGACTTCTTCAAGCGTGCAGC
CTTTCTGACTGTTTCAGGCCAACTTCAGGTTGAGACTTATGCTTGTGCTCTCAGCAGTGTCTATACC
TTTGGACCCACATTCCGGGCAGAGAACTCACATACGTCAAGACATTTGGCAGAATTTTGGATGGTTG
AACCAGAAATTGCATATGCAAACTTGCAT**AAAGGTATGGATAGTGTATCTTCATACTGCATTTGTTT
AATTTGAAAATGGTTATCTAGTTGCCTAACAAAATATAGCTGGGATATCTTATAACACATGTGCAGG
TGACATGGAAAAAAATGCCTATTTTTCTATGCACTAACTATTCATCATGTGACATACTTCCCCAAAA
AACTAAATAAGCCAAATTTTCCAGCTTCCGAGTCCTGAAAAGAGTAGTGTACCTGATACAATTTAT**

FIG. 60

AGAGTTTTTTTTTTCGAAAAGAAGGGATAGCCCTCATAGATAGAGTACTAACTAAAAGTCTACTTTT
ACCAATTTCAGGTTTTTGATGCAAGTTTGCATATGCAATTTCTGGTTCAACCATCCAAAATTCTGCC
AAATGTCTTGACGTATGTGAGTTCTCTGCCCGGAATGTGGGTCCAAAGGTATAGACACTGCTGAGAG
CACAAGCATAAGTCTCAACCTGAAGTTGGCCTGAAACAGTCAGAAAGGCTGCACGCTTGAAGAAGTC
ATTCTCAAACGCAATGGACCCATCATCTTTGTGGCGAATTCCAGGTTTCAACTTAGACCTCTCTTCC
AGCCTTAAGACAACCTCTTTTGCCTTTGTAAGCTCCGAAACAGCAGCAGTTATCTCTTGCTTGCTAG
CTTTTGCTGCTTTAAGTTGCGCAACTGCATCTCCTTTTCCCTTGACAACAAGCTTAGCAGCCTCAAC
ATCAGCTTCAGATGGTGCAGGGTTCTCCTTAAGCTCCTTGTCAACCTTTTCAGCCTGGCTGAACAAG
GAGGTGACTTGGAACATCTCACCGGCACCCTCACAATCGC*AGAAGGAGTGCGTCGAAGCAGATCGTT*
*CAAACATTTGGCAATAAAGTTTCTTAAGATTGAATCCTGTTGCCGGTCTTGCGATGATTATCATATA*
*ATTTCTGTTGAATTACGTTAAGCATGTAATAATTAACATGTAATGCATGACGTTATTTATGAGATGG*
*GTTTTTATGATTAGAGTCCCGCAATTATACATTTAATACGCGATAGAAAACAAAATATAGCGCGCAA*
*ACTAGGATAAATTATCGCGCGGTGTCATCTATGTTACTAGATCGA*ACCCAGCTTTCTTGTACAAA
GTGGTCCCC

FIG. 60 (cont)

LpOs05g0149100

GGGGACAAGTTTGTACAAAAAAGCAGGCT_GTGCAGCGTGACCCGGTCGTGCCCCTCTCTAGAGATAA_
_TGAGCATTGCATGTCTAAGTTATAAAAAATTACCACATATTTTTTTGTCACACTTGTTTGAAGTGC_
_AGTTTATCTATCTTTATACATATATTTAAACTTTACTCTACGAATAATATAATCTATAGTACTACAA_
_TAATATCAGTGTTTTAGAGAATCATATAAATGAACAGTTAGACATGGTCTAAAGGACAATTGAGTAT_
_TTTGACAACAGGACTCTACAGTTTTATCTTTTTAGTGTGCATGTGTTCTCCTTTTTTTTGCAAATA_
_GCTTCACCTATATAATACTTCATCCATTTTATTAGTACATCCATTTAGGGTTTAGGGTTAATGGTTT_
_TTATAGACTAATTTTTTTAGTACATCTATTTTATTCTATTTTAGCCTCTAAATTAAGAAAACTAAAA_
_CTCTATTTTAGTTTTTTTATTTAATAATTTAGATATAAAATAGAATAAAATAAAGTGACTAAAAATT_
_AAACAAATACCCTTTAAGAAATTAAAAAAACTAAGGAAACATTTTTCTTGTTTCGAGTAGATAATGC_
_CAGCCTGTTAAACGCCGTCGACGAGTCTAACGGACACCAACCAGCGAACCAGCAGCGTCGCGTCGGG_
_CCAAGCGAAGCAGACGGCACGGCATCTCTGTCGCTGCCTCTGGACCCCTCTCGAGAGTTCCGCTCCA_
_CCGTTGGACTTGCTCCGCTGTCGGCATCCAGAAATTGCGTGGCGGAGCGGCAGACGTGAGCCGGCAC_
_GGCAGGCGGCCTCCTCCTCCTCTCACGGCACGGCAGCTACGGGGGATTCCTTTCCCACCGCTCCTTC_
_GCTTTCCCTTCCTCGCCCGCCGTAATAAATAGACACCCCTCCACACCCTCTTTCCCCAACCTCGTG_
_TTGTTCGGAGCGCACACACACACAACCAGATCTCCCCCAAATCCACCGTCGGCACCTCCGCTTCAA_
GGTACGCCGCTCGTCCTCCCCCCCCCCCCCTCTCTACCTTCTCTAGATCGGCGTTCCGGTCCATGGT
TAGGGCCCGGTAGTTCTACTTCTGTTCATGTTTGTGTTAGATCCGTGTTTGTGTTAGATCCGTGCTG
CTAGCGTTCGTACACGGATGCGACCTGTACGTCAGACACGTTCTGATTGCTAACTTGCCAGTGTTTC
TCTTTGGGGAATCCTGGGATGGCTCTAGCCGTTCCGCAGACGGGATCGATTTCATGATTTTTTTGT
TTCGTTGCATAGGGTTTGGTTTGCCCTTTTCCTTTATTTCAATATATGCCGTGCACTTGTTTGTCGG
GTCATCTTTTCATGCTTTTTTTTGTCTTGGTTGTGATGATGTGGTCTGGTTGGGCGGTCGTTCTAGA
TCGGAGTAGAATTCTGTTTCAAACTACCTGGTGGATTTATTAATTTTGGATCTGTATGTGTGTGCCA
TACATATTCATAGTTACGAATTGAAGATGATGGATGGAAATATCGATCTAGGATAGGTATACATGTT
GATGCGGGTTTTACTGATGCATATACAGAGATGCTTTTTGTTCGCTTGGTTGTGATGATGTGGTGTG
GTTGGGCGGTCGTTCATTCGTTCTAGATCGGAGTAGAATACTGTTTCAAACTACCTGGTGTATTTAT
TAATTTTGGAACTGTATGTGTGTGTCATACATCTTCATAGTTACGAGTTTAAGATGGATGGAAATAT
CGATCTAGGATAGGTATACATGTTGATGTGGGTTTTACTGATGCATATACATGATGGCATATGCAGC
ATCTATTCATATGCTCTAACCTTGAGTACCTATCTATTATAATAAACAAGTATGTTTTATAATTATT
TTGATCTTGATATACTTGGATGATGGCATATGCAGCAGCTATATGTGGATTTTTTTAGCCCTGCCTT
CATACGCTATTTATTTGCTTGGTACTGTTTCTTTTGTCGATGCTCACCCTGTTGTTTGGTGTTACTT
CTGCAGGTCTCGGGAAACACGCATTGGCAATACCGGCCGATCGATCGACAGATCGGCACGGGGTCCG
GCGAGGCGCGATGGCGTATCGGGTGCTGGAGGTGACGCTGATCTCGGCCAAGGACCTGAAGAAGGTG
ACGGTGTTCTCCAAGATGCGGGTGTACGCGGTGGCGTCCATCTCCGGCGGCGACCCGCGCACGCCGA
CGCACCGGACGCACTCGGACCGGCACGGCGGGCCGCTGCGGTTCCCAATACCGATCGCCGCCGACCC
CCGCGGGCTCGCACTGCACGTGCTCCTCCGCTCCGAGCGCTCCTTCGGCGACCGCGACGTCGGCGAG
GTGCTCGTCCCCGTCCAGGACCTTTTCGCCGCAGCGCCTCTCGCCGGCGAGCATCGCCACCTCAGCT
ACCAGGTGCGACGCCCATGAGCGGCCGGAAGCGCGGGGTGCTCCACATCTCCTACAGCCTCACGGA
CGCGCCGGCGATAGGGAAAGGTATGGATAGTGTATCTTCATACTGCATTTGTTTAATTTGAAAATGG
TTATCTAGTTGCCTAACAAAATATAGCTGGGATATCTTATAACACATGTGCAGGTGACATGGAAAAA
AATGCCTATTTTTCTATGCACTAACTATTCATCATGTGACATACTTCCCCAAAAAACTAAATAAGCC
AAATTTTCCAGCTTCCGAGTCCTGAAAAAGAGTAGTGTACCTGATACAATTTATAGAGTTTTTTTTT

FIG. 61

TCGAAAAGAAGGGATAGCCCTCATAGATAGAGTACTAACTAAAAGTCTACTTTTACCAATTTCAGGT
TTTTGCCCTATCGCCGGCGCGTCCGTGAGGCTGTAGCAGATGTGGAGCACCCCGCGCTTCCGGCCGC
TCATGGGGCGTCGCACCTGGTAGCTGAGGTGGCGATGCTCGCCGGCGAGAGGCGCTGCGGCGAAAAG
GTCCTGGACGGGGACGAGCACCTCGCCGACGTCGCGGTCGCCGAAGGAGCGCTCGGAGCGGAGGAGC
ACGTGCAGTGCGAGCCCGCGGGGGTCGGCGGCGATCGGTATTGGGAACCGCAGCGGCCCGCCGTGCC
GGTCCGAGTGCGTCCGGTGCGTCGGCGTGCGCGGGTCGCCGCCGGAGATGGACGCCACCGCGTACAC
CCGCATCTTGGAGAACACCGTCACCTTCTTCAGGTCCTTGGCCGAGATCAGCGTCACCTCCAGCACC
CGATACGCCATCGCGCCTCGCCGGACCCCGTGCCGATCTGTCGATCGATCGGCCGGTATTGCCAATG
CGTGTTTCCCGAGA*AGAAGGAGTGCGTCGAAGCAGATCGTTCAAACATTTGGCAATAAAGTTTCTTA*
*AGATTGAATCCTGTTGCCGGTCTTGCGATGATTATCATATAATTTCTGTTGAATTACGTTAAGCATG*
*TAATAATTAACATGTAATGCATGACGTTATTTATGAGATGGGTTTTTATGATTAGAGTCCCGCAATT*
*ATACATTTAATACGCGATAGAAAACAAAATATAGCGCGCAAACTAGGATAAATTATCGCGCGCGGTG*
*TCATCTATGTTACTAGATCGAA*CCCAGCTTTCTTGTACAAAGTGGTCCCC

FIG. 61 (cont)

LpOs05g0149500

GGGGACAAGTTTGTACAAAAAAGCAGGCTGTGCAGCGTGACCCGGTCGTGCCCCTCTCTAGAGATAA
TGAGCATTGCATGTCTAAGTTATAAAAAATTACCACATATTTTTTTGTCACACTTGTTTGAAGTGC
AGTTTATCTATCTTTATACATATATTTAAACTTTACTCTACGAATAATATAATCTATAGTACTACAA
TAATATCAGTGTTTTAGAGAATCATATAAATGAACAGTTAGACATGGTCTAAAGGACAATTGAGTAT
TTTGACAACAGGACTCTACAGTTTTATCTTTTTAGTGTGCATGTGTTCTCCTTTTTTTTGCAAATA
GCTTCACCTATATAATACTTCATCCATTTTATTAGTACATCCATTTAGGGTTTAGGGTTAATGGTTT
TTATAGACTAATTTTTTTAGTACATCTATTTTATTCTATTTTAGCCTCTAAATTAAGAAAACTAAAA
CTCTATTTTAGTTTTTTTATTTAATAATTTAGATATAAAATAGAATAAAATAAAGTGACTAAAAATT
AAACAAATACCCTTTAAGAAATTAAAAAAACTAAGGAAACATTTTTCTTGTTTCGAGTAGATAATGC
CAGCCTGTTAAACGCCGTCGACGAGTCTAACGGACACCAACCAGCGAACCAGCAGCGTCGCGTCGGG
CCAAGCGAAGCAGACGGCACGGCATCTCTGTCGCTGCCTCTGGACCCCTCTCGAGAGTTCCGCTCCA
CCGTTGGACTTGCTCCGCTGTCGGCATCCAGAAATTGCGTGGCGGAGCGGCAGACGTGAGCCGGCAC
GGCAGGCGGCCTCCTCCTCCTCTCACGGCACGGCAGCTACGGGGGATTCCTTTCCCACCGCTCCTTC
GCTTTCCCTTCCTCGCCCGCCGTAATAAATAGACACCCCCTCCACACCCTCTTT<u>CCCCAACCTCGTG
TTGTTCGGAGCGCACACACACACAACCAGATCTCCCCAAATCCACCCGTCGCACCTCCGCTTCAA
G</u>**GTACGCCGCTCGTCCTCCCCCCCCCCCCTCTCTACCTTCTCTAGATCGGCGTTCCGGTCCATGGT
TAGGGCCCGGTAGTTCTACTTCTGTTCATGTTTGTGTTAGATCCGTGTTTGTGTTAGATCCGTGCTG
CTAGCGTTCGTACACGGATGCGACCTGTACGTCAGACACGTTCTGATTGCTAACTTGCCAGTGTTTC
TCTTTGGGGAATCCTGGGATGGCTCTAGCCGTTCCGCAGACGGGATCGATTTCATGATTTTTTTGT
TTCGTTGCATAGGGTTTGGTTTGCCCTTTTCCTTTATTTCAATATATGCCGTGCACTTGTTTGTCGG
GTCATCTTTTCATGCTTTTTTTTGTCTTGGTTGTGATGATGTGGTCGGTTGGGCGGTCGTTCTAGA
TCGGAGTAGAATTCTGTTTCAAACTACCTGGTGGATTTATTAATTTTGGATCTGTATGTGTGTGCCA
TACATATTCATAGTTACGAATTGAAGATGATGGATGGAAATATCGATCTAGGATAGGTATACATGTT
GATGCGGGTTTTACTGATGCATATACAGAGATGCTTTTTGTTCGCTTGGTTGTGATGATGTGGTGTG
GTTGGGCGGTCGTTCATTCGTTCTAGATCGGAGTAGAATACTGTTTCAAACTACCTGGTGTATTTAT
TAATTTTGGAACTGTATGTGTGTGTCATACATCTTCATAGTTACGAGTTTAAGATGGATGGAAATAT
CGATCTAGGATAGGTATACATGTTGATGTGGGTTTTACTGATGCATATACATGATGGCATATGCAGC
ATCTATTCATATGCTCTAACCTTGAGTACCTATCTATTATAATAAACAAGTATGTTTTATAATTATT
TTGATCTTGATATACTTGGATGATGGCATATGCAGCAGCTATATGTGGATTTTTTTAGCCCTGCCTT
CATACGCTATTTATTTGCTTGGTACTGTTTCTTTTGTCGATGCTCACCCTGTTGTTTGGTGTTACTT
CTGCAGG**ATGCGCGTCACCATCACCGGCGGCGGGACGAGGCTGCACGTGGACCTCTACTACGCGTGC
GTGCAGAGCCGCGCGCTCTTCACGGTGTGGAGCCTCCTGCAGCTGATGCGGCGGCACCGCGGCCGCG
TCCCCGACGTGGACCTCATGTTCGACTGCATGGACCGGCCCGCCATCAACCGCACCGAGCACAGCGG
CGAGGGCGCGCCCCCTCCGCCGCCGCTGTTCCGGTACTGCACCACTCGCGACCACTTCGACATCCCG
TTCCCGGACTGGTCCTTCTGGGGCTGGCCGGAGACGCACCTCGAGCCCTGGAGCCGCGAGTTCAAGA
GCATCCGGCAGGGCGCCAAGAAGAACTGGGACGAGGAGGCGAGGTCCGGGTACCAGAACTCGAAGCT
GTCGAGCCAGTGCACGCACCGGTACAAGATCTACGCGGAGGGGTTCGCGTGGTCGGTGAGCCTGAAA
TACATCCTCTCCTGCGGCTCCACGGCGCTCCTGATCGACCCGCTGTACCAGGACTTCTTCAGCCGGG
GGCTGGAGCCGCGGGTGAACCACCTGCCGGTGAGCACCGTGGGGATGTGCGAGTCCATCAGGGACGC
CGTGGAGTGGGGCAACGCGCACCCGGACGAGGCGGAGCGCGTCGGGCGGCGCGGGCAGCGGCTGATG
CAGGACCTGGCCATGGACGCC**AAAGGTATGGATAGTGTATCTTCATACTGCATTTGTTTAATTTGAA

FIG. 62

**AATGGTTATCTAGTTGCCTAACAAAATATAGCTGGGATATCTTATAACACATGTGCAGGTGACATGG
AAAAAAATGCCTATTTTTCTATGCACTAACTATTCATCATGTGACATACTTCCCCAAAAAACTAAAT
AAGCCAAATTTTCCAGCTTCCGAGTCCTGAAAAAGAGTAGTGTACCTGATACAATTTATAGAGTTTT
TTTTTTCGAAAAGAAGGGATAGCCCTCATAGATAGAGTACTAACTAAAAGTCTACTTTTACCAATTT
CAGGTTTTTG**GGCGTCCATGGCCAGGTCCTGCATCAGCCGCTGCCCGCGCCGCCCGACGCGCTCCGC
CTCGTCCGGGTGCGCGTTGCCCCACTCCACGGCGTCCCTGATGGACTCGCACATCCCCACGGTGCTC
ACCGGCAGGTGGTTCACCCGCGGCTCCAGCCCCCGGCTGAAGAAGTCCTGGTACAGCGGGTCGATCA
GGAGCGCCGTGGAGCCGCAGGAGAGGATGTATTTCAGGCTCACCGACCACGCGAACCCCTCCGCGTA
GATCTTGTACCGGTGCGTGCACTGGCTCGACAGCTTCGAGTTCTGGTACCCGGACCTCGCCTCCTCG
TCCCAGTTCTTCTTGGCGCCCTGCCGGATGCTCTTGAACTCGCGGCTCCAGGGCTCGAGGTGCGTCT
CCGGCCAGCCCCAGAAGGACCAGTCCGGGAACGGGATGTCGAAGTGGTCGCGAGTGGTGCAGTACCG
GAACAGCGGCGGCGGAGGGGGCGCGCCCTCGCCGCTCTGCTCGGTGCGGTTGATGGCGGGCCGGTCC
ATGCAGTCGAACATGAGGTCCACGTCGGGGACGCGGCCGCGGTGCCGCCGCATCAGCTGCAGGAGGC
TCCACACCGTGAAGAGCGCGCGGCTCTGCACGCACGCGTAGTAGAGGTCCACGTGCAGCCTCGTCCC
GCCGCCGGTGATGGTGACGCGCAT*AGAAGGAGTGCGTCGAAGCAGATCGTTCAAACATTTGGCAATA
AAGTTTCTTAAGATTGAATCCTGTTGCCGGTCTTGCGATGATTATCATATAATTTCTGTTGAATTAC
GTTAAGCATGTAATAATTAACATGTAATGCATGACGTTATTTATGAGATGGGTTTTTATGATTAGAG
TCCCGCAATTATACATTTAATACGCGATAGAAAACAAAATATAGCGCGCAAACTAGGATAAATTATC
GCGCGCGGTGTCATCTATGTTACTAGATCGA*ACCCAGCTTTCTTGTACAAAGTGGTCCCC

FIG. 62 (cont)

LpOs05g0149600 - CULLIN

```
GGGGACAAGT TTGTACAAAA AAGCAGGCTG TGCAGCGTGA CCCGGTCGTG CCCCTCTCTA
GAGATAATGA GCATTGCATG TCTAAGTTAT AAAAAATTAC CACATATTTT TTTTGTCACA
CTTGTTTGAA GTGCAGTTTA TCTATCTTTA TACATATATT TAAACTTTAC TCTACGAATA
ATATAATCTA TAGTACTACA ATAATATCAG TGTTTTAGAG AATCATATAA ATGAACAGTT
AGACATGGTC TAAAGGACAA TTGAGTATTT TGACAACAGG ACTCTACAGT TTTATCTTTT
TAGTGTGCAT GTGTTCTCCT TTTTTTTTGC AAATAGCTTC ACCTATATAA TACTTCATCC
ATTTTATTAG TACATCCATT TAGGGTTTAG GGTTAATGGT TTTTATAGAC TAATTTTTTT
AGTACATCTA TTTTATTCTA TTTTAGCCTC TAAATTAAGA AAACTAAAAC TCTATTTTAG
TTTTTTTATT TAATAATTTA GATATAAAAT AGAATAAAAT AAAGTGACTA AAAATTAAAC
AAATACCCTT TAAGAAATTA AAAAAACTAA GGAAACATTT TTCTTGTTTC GAGTAGATAA
TGCCAGCCTG TTAAACGCCG TCGACGAGTC TAACGGACAC CAACCAGCGA ACCAGCAGCG
TCGCGTCGGG CCAAGCGAAG CAGACGGCAC GGCATCTCTG TCGCTGCCTC TGGACCCCTC
TCGAGAGTTC CGCTCCACCG TTGGACTTGC TCCGCTGTCG GCATCAGAA ATTGCGTGGC
GGAGCGGCAG ACGTGAGCCG GCACGGCAGG CGGCCTCCTC CTCCTCTCAC GGCACGGCAG
CTACGGGGGA TTCCTTTCCC ACCGCTCCTT CGCTTTCCCT TCCTCGCCCG CCGTAATAAA
TAGACACCCC CTCCACACCC TCTTTCCCCA ACCTCGTGTT GTTCGGAGCG CACACACACA
CAACCAGATC TCCCCCAAAT CCACCCGTCG GCACCTCCGC TTCAAGGTAC GCCGCTCGTC
CTCCCCCCCC CCCCCTCTCT ACCTTCTCTA GATCGGCGTT CCGGTCCATG GTTAGGGCCC
GGTAGTTCTA CTTCTGTTCA TGTTTGTGTT AGATCCGTGT TTGTGTTAGA TCCGTGCTGC
TAGCGTTCGT ACACGGATGC GACCTGTACG TCAGACACGT TCTGATTGCT AACTTGCCAG
TGTTTCTCTT TGGGGAATCC TGGGATGGCT CTAGCCGTTC CGCAGACGGG ATCGATTTCA
TGATTTTTTT TGTTTCGTTG CATAGGGTTT GGTTTGCCCT TTTCCTTTAT TTCAATATAT
GCCGTGCACT TGTTTGTCGG GTCATCTTTT CATGCTTTTT TTTGTCTTGG TTGTGATGAT
GTGGTCTGGT TGGGCGGTCG TTCTAGATCG GAGTAGAATT CTGTTTCAAA CTACCTGGTG
GATTTATTAA TTTTGGATCT GTATGTGTGT GCCATACATA TTCATAGTTA CGAATTGAAG
ATGATGGATG GAAATATCGA TCTAGGATAG GTATACATGT TGATGCGGGT TTTACTGATG
CATATACAGA GATGCTTTTT GTTCGCTTGG TTGTGATGAT GTGGTGTGGT TGGGCGGTCG
TTCATTCGTT CTAGATCGGA GTAGAATACT GTTTCAAACT ACCTGGTGTA TTTATTAATT
TTGGAACTGT ATGTGTGTGT CATACATCTT CATAGTTACG AGTTTAAGAT GGATGGAAAT
ATCGATCTAG GATAGGTATA CATGTTGATG TGGGTTTTAC TGATGCATAT ACATGATGGC
ATATGCAGCA TCTATTCATA TGCTCTAACC TTGAGTACCT ATCTATTATA ATAAACAAGT
ATGTTTTATA ATTATTTTGA TCTTGATATA CTTGGATGAT GGCATATGCA GCAGCTATAT
GTGGATTTTT TTAGCCCTGC CTTCATACGC TATTTATTTG CTTGGTACTG TTTCTTTTGT
CGATGCTCAC CCTGTTGTTT GGTGTTACTT CTGCAGGGGA GAAGGAACAT TCTGGATGTT
ATGCATTGCT TCGGGATGAC AAGGTGGATG ATCTTAAAAG GATGTTTTCG CTCTTCTCAA
AAATCACCCG TGGTCTGGAA CCTGTTTCTA ACATGTTCAA ATCGCATGTT ACGAATGAGG
GTACAGCTTT GGTCAAGCAA GCAGAAGATT CTGCTAGTAA TAAAAAGCCA GAGAAGAAGG
AGATGGTTGG AATGCAGGAA CAGGTTTTTG TCTGGAAAAT CATTGCACTG CATGATAAGT
ATGTAGCATA TGTGACAGAT TGTTCCACG GCCATACACT CTTCCACAAG GCACTTAAAG
AAGCCTTTGA GGTCTTCTGC AATAAGGGTG TCTCTGGCAG TTCGAGTGCT GAATTGCTCG
CCACCTTCTG TGACAACATT CTGAAGAAAG GCTGCAGTGA AAAGCTCAGT GATGAAGCCA
TTGAAGATGC CCTTGAGAAG GTGGTGCGCC TGCTTGCATA CATAAGTGAT AAAGACCAAA
GGTATGGATA GTGTATCTTC ATACTGCATT TGTTTAATTT GAAATGGTT ATCTAGTTGC
CTAACAAAAT ATAGCTGGGA TATCTTATAA CACATGTGCA GGTGACATGG AAAAAAATGC
CTATTTTTCT ATGCACTAAC TATTCATCAT GTGACATACT TCCCCAAAAA ACTAAATAAG
CCAAATTTTC CAGCTTCCGA GTCCTGAAAA AGAGTAGTGT ACCTGATACA ATTTATAGAG
```

FIG. 63

TTTTTTTTTT GTACTAACTA AAAGTCTACT TTTACCAATT TCAGGTTTTT GGGTCTTTAT
CACTTATGTA TGCAAGCAGG CGCACCACCT TCTCAAGGGC ATCTTCAATG GCTTCATCAC
TGAGCTTTTC ACTGCAGCCT TTCTTCAGAA TGTTGTCACA GAAGGTGGCG AGCAATTCAG
CACTCGAACT GCCAGAGACA CCCTTATTGC AGAAGACCTC AAAGGCTTCT TTAAGTGCCT
TGTGGAAGAG TGTATGGCCG TGGAAACAAT CTGTCACATA TGCTACATAC TTATCATGCA
GTGCAATGAT TTTCCAGACA AAAACCTGTT CCTGCATTCC AACCATCTCC TTCTTCTCTG
GCTTTTTATT ACTAGCAGAA TCTTCTGCTT GCTTGACCAA AGCTGTACCC TCATTCGTAA
CATGCGATTT GAACATGTTA GAAACAGGTT CCAGACCACG GGTGATTTTT GAGAAGAGCG
AAAACATCCT TTTAAGATCA TCCACCTTGT CATCCCGAAG CAATGCATAA CATCCAGAAT
CTTCCTTCTC C*AGAAGGAGT GCGTCGAAGC AGATCGTTCA AACATTTGGC AATAAAGTTT
CTTAAGATTG AATCCTGTTG CCGGTCTTGC GATGATTATC ATATAATTTC TGTTGAATTA
CGTTAAGCAT GTAATAATTA ACATGTAATG CATGACGTTA TTTATGAGAT GGGTTTTTAT
GATTAGAGTC CCGCAATTAT ACATTTAATA CGCGATAGAA AACAAAATAT AGCGCGCAAA
CTAGGATAAA TTATCGCGCG CGGTGTCATC TATGTTACTA GATCGA*ACCC AGCTTTCTTG
TACAAAGTGG T</u>CCCC

FIG. 63 (cont)

LpOs05g0150400

GGGGACAAGTTTGTACAAAAAAGCAGGCT_GTGCAGCGTGACCCGGTCGTGCCCCTCTCTAGAGATAA_
_TGAGCATTGCATGTCTAAGTTATAAAAAATTACCACATATTTTTTTGTCACACTTGTTTGAAGTGC_
_AGTTTATCTATCTTTATACATATATTTAAACTTTACTCTACGAATAATATAATCTATAGTACTACAA_
_TAATATCAGTGTTTTAGAGAATCATATAAATGAACAGTTAGACATGGTCTAAAGGACAATTGAGTAT_
_TTTGACAACAGGACTCTACAGTTTTATCTTTTTAGTGTGCATGTGTTCTCCTTTTTTTTGCAAATA_
_GCTTCACCTATATAATACTTCATCCATTTTATTAGTACATCCATTTAGGGTTTAGGGTTAATGGTTT_
_TTATAGACTAATTTTTTTAGTACATCTATTTTATTCTATTTTAGCCTCTAAATTAAGAAAACTAAAA_
_CTCTATTTTAGTTTTTTTATTTAATAATTTAGATATAAAATAGAATAAAATAAAGTGACTAAAAATT_
_AAACAAATACCCTTTAAGAAATTAAAAAAACTAAGGAAACATTTTTCTTGTTTCGAGTAGATAATGC_
_CAGCCTGTTAAACGCCGTCGACGAGTCTAACGGACACCAACCAGCGAACCAGCAGCGTCGCGTCGGG_
_CCAAGCGAAGCAGACGGCACGGCATCTCTGTCGCTGCCTCTGGACCCCTCTCGAGAGTTCCGCTCCA_
_CCGTTGGACTTGCTCCGCTGTCGGCATCCAGAAATTGCGTGGCGGAGCGGCAGACGTGAGCCGGCAC_
_GGCAGGCGGCCTCCTCCTCCTCTCACGGCACGGCAGCTACGGGGATTCCTTTCCCACCGCTCCTTC_
_GCTTTCCCTTCCTCGCCCGCCGTAATAAATAGACACCCCTCCACACCCTCTTTCCCCAACCTCGTG_
_TTGTTCGGAGCGCACACACACACAACCAGATCTCCCCCAAATCCACCCGTCGGCACCTCCGCTTCAA_
_G_GTACGCCGCTCGTCCTCCCCCCCCCCCTCTCTACCTTCTCTAGATCGGCGTTCCGGTCCATGGT
TAGGGCCCGGTAGTTCTACTTCTGTTCATGTTTGTGTTAGATCCGTGTTTGTGTTAGATCCGTGCTG
CTAGCGTTCGTACACGGATGCGACCTGTACGTCAGACACGTTCTGATTGCTAACTTGCCAGTGTTTC
TCTTTGGGGAATCCTGGGATGGCTCTAGCCGTTCCGCAGACGGGATCGATTTCATGATTTTTTTGT
TTCGTTGCATAGGGTTTGGTTTGCCCTTTTCCTTTATTTCAATATATGCCGTGCACTTGTTTGTCGG
GTCATCTTTTCATGCTTTTTTTGTCTTGGTTGTGATGATGTGGTCTGGTTGGGCGGTCGTTCTAGA
TCGGAGTAGAATTCTGTTTCAAACTACCTGGTGGATTTATTAATTTTGGATCTGTATGTGTGTGCCA
TACATATTCATAGTTACGAATTGAAGATGATGGATGGAAATATCGATCTAGGATAGGTATACATGTT
GATGCGGTTTTACTGATGCATATACAGAGATGCTTTTTGTTCGCTTGGTTGTGATGATGTGGTGTG
GTTGGGCGGTCGTTCATTCGTTCTAGATCGGAGTAGAATACTGTTTCAAACTACCTGGTGTATTTAT
TAATTTTGGAACTGTATGTGTGTGTCATACATCTTCATAGTTACGAGTTTAAGATGGATGGAAATAT
CGATCTAGGATAGGTATACATGTTGATGTGGGTTTTACTGATGCATATACATGATGGCATATGCAGC
ATCTATTCATATGCTCTAACCTTGAGTACCTATCTATTATAATAAACAAGTATGTTTTATAATTATT
TTGATCTTGATATACTTGGATGATGGCATATGCAGCAGCTATATGTGGATTTTTTAGCCCTGCCTT
CATACGCTATTTATTTGCTTGGTACTGTTTCTTTTGTCGATGCTCACCCTGTTGTTTGGTGTTACTT
CTGCAGGTGCCTCGAGTAGGTGAGGTAGCATCTTCATCTTCTCCATCCGATCATGACAATGAGGAGC
AGGAACAGGTCACAGTTGTCCGCACTCTTGAAAGCTTGAACCAGAAAAATGAAGGCAAGGCACCACA
TCAAAAGGAAAAGCAGCAACGCAATAACCGCCCGCAACCTCGGAGATCTTATCCTAAACCAAGTGCG
TCATTTTACGGATCACGCTTACAAAATCAGACATACCCAAATGTTGCACAAGAGCAAGCAATGTACC
ATATGTGGCACCAGGTGCAACCAACACAGCAGAAGCCCCATTTTCGGATGGTTCCAACTATGGGCAA
CACAAGGTTTCCACCGCCACCAACTATACTCCATGTACCCTCCACCTAGAGGACAGTTCGCCGTG
CCAGCCAGCCAAGATGCTTTGGCTCTAATTCCATGTTTTCCTGAAGCTGCTCCTGCCCTTCCACGGT
ACTTCTCGCCTTACCCTGCCTCATACGTACCAGCAAGTCCACTGCCAGCTGCAGTTAACATGATGCA
TGGGAGAAGGCAAGGGTGTGCTGAAACGGTTGAGCTTCCTGATGCACCAGTTTTCGCCAGATACACT
GCTCAAAGGTATGGATAGTGTATCTTCATACTGCATTTGTTTAATTTGAAAATGGTTATCTAGTTGC
CTAACAAAATATAGCTGGGATATCTTATAACACATGTGCAGGTGACATGGAAAAAATGCCTATTTT
TCTATGCACTAACTATTCATCATGTGACATACTTCCCCAAAAAACTAAATAAGCCAAATTTTCCAGC

FIG. 64

TTCCGAGTCCTGAAAAAGAGTAGTGTACCTGATACAATTTATAGAGTTTTTTTTTCGAAAAGAAGG
GATAGCCCTCATAGATAGAGTACTAACTAAAAGTCTACTTTTACCAATTTCAGGTTTTTGGAGCAGT
GTATCTGGCGAAAACTGGTGCATCAGGAAGCTCAACCGTTTCAGCACACCCTTGCCTTCTCCCATGC
ATCATGTTAACTGCAGCTGGCAGTGGACTTGCTGGTACGTATGAGGCAGGGTAAGGCGAGAAGTACC
GTGGAAGGGCAGGAGCAGCTTCAGGAAAACATGGAATTAGAGCCAAAGCATCTTGGCTGGCTGGCAC
GGCGAACTGTCCTCTAGGTGGAGGGTACATGGAGAGTATAGTTGGTGGCGGTGGAAACCTTGTGTTG
CCCATAGTTGGAACCATCCGAAAATGGGGCTTCTGCTGTGTTGGTTGCACCTGGTGCCACATATGGT
ACATTGCTTGCTCTTGTGCAACATTTGGGTATGTCTGATTTTGTAAGCGTGATCCGTAAAATGACGC
ACTTGGTTTAGGATAAGATCTCCGAGGTTGCGGGCGGTTATTGCGTTGCTGCTTTTCCTTTTGATGT
GGTGCCTTGCCTTCATTTTTCTGGTTCAAGCTTTCAAGAGTGCGGACAACTGTGACCTGTTCCTGCT
CCTCATTGTCATGATCGGATGGAGAAGATGAAGATGCTACCTCACCTACTCGAGGCA*AGAAGGAGTG*
*CGTCGAAGCAGATCGTTCAAACATTTGGCAATAAAGTTTCTTAAGATTGAATCCTGTTGCCGGTCTT*
*GCGATGATTATCATATAATTTCTGTTGAATTACGTTAAGCATGTAATAATTAACATGTAATGCATGA*
*CGTTATTTATGAGATGGGTTTTTATGATTAGAGTCCCGCAATTATACATTTAATACGCGATAGAAAA*
*CAAAATATAGCGCGCAAACTAGGATAAATTATCGCGCGGTGTCATCTATGTTACTAGATCGA*ACC
CAGCTTTCTTGTACAAAGTGGTCCCC

FIG. 64 (cont)

LpOs05g0150500

GGGGACAAGTTTGTACAAAAAAGCAGGCTGTGCAGCGTGACCCGGTCGTGCCCCTCTCTAGAGATAA
TGAGCATTGCATGTCTAAGTTATAAAAAATTACCACATATTTTTTTGTCACACTTGTTTGAAGTGC
AGTTTATCTATCTTTATACATATATTTAAACTTTACTCTACGAATAATATAATCTATAGTACTACAA
TAATATCAGTGTTTTAGAGAATCATATAAATGAACAGTTAGACATGGTCTAAAGGACAATTGAGTAT
TTTGACAACAGGACTCTACAGTTTTATCTTTTTAGTGTGCATGTGTTCTCCTTTTTTTTGCAAATA
GCTTCACCTATATAATACTTCATCCATTTTATTAGTACATCCATTTAGGGTTTAGGGTTAATGGTTT
TTATAGACTAATTTTTTAGTACATCTATTTTATTCTATTTTAGCCTCTAAATTAAGAAAACTAAAA
CTCTATTTTAGTTTTTTATTTAATAATTTAGATATAAAATAGAATAAAATAAAGTGACTAAAAATT
AAACAAATACCCTTTAAGAAATTAAAAAAACTAAGGAAACATTTTTCTTGTTTCGAGTAGATAATGC
CAGCCTGTTAAACGCCGTCGACGAGTCTAACGGACACCAACCAGCGAACCAGCAGCGTCGCGTCGGG
CCAAGCGAAGCAGACGGCACGGCATCTCTGTCGCTGCCTCTGGACCCCTCTCGAGAGTTCCGCTCCA
CCGTTGGACTTGCTCCGCTGTCGGCATCCAGAAATTGCGTGGCGGAGCGGCAGACGTGAGCCGGCAC
GGCAGGCGGCCTCCTCCTCCTCTCACGGCACGGCAGCTACGGGGATTCCTTTCCCACCGCTCCTTC
GCTTTCCCTTCCTCGCCCGCCGTAATAAATAGACACCCCTCCACACCCTCTTT<u>CCCCAACCTCGTG</u>
<u>TTGTTCGGAGCGCACACACACACAACCAGATCTCCCCCAAATCCACCCGTCGGCACCTCCGCTTCAA</u>
<u>G</u>**GTACGCCGCTCGTCCTCCCCCCCCCCCCTCTCTACCTTCTCTAGATCGGCGTTCCGGTCCATGGT
TAGGGCCCGGTAGTTCTACTTCTGTTCATGTTTGTGTTAGATCCGTGTTTGTGTTAGATCCGTGCTG
CTAGCGTTCGTACACGGATGCGACCTGTACGTCAGACACGTTCTGATTGCTAACTTGCCAGTGTTTC
TCTTTGGGGAATCCTGGGATGGCTCTAGCCGTTCCGCAGACGGGATCGATTTCATGATTTTTTTGT
TTCGTTGCATAGGGTTTGGTTTGCCCTTTTCCTTTATTTCAATATATGCCGTGCACTTGTTTGTCGG
GTCATCTTTTCATGCTTTTTTTTGTCTTGGTTGTGATGATGTGGTCTGGTTGGGCGGTCGTTCTAGA
TCGGAGTAGAATTCTGTTTCAAACTACCTGGTGGATTTATTAATTTTGGATCTGTATGTGTGTGCCA
TACATATTCATAGTTACGAATTGAAGATGATGGATGGAAATATCGATCTAGGATAGGTATACATGTT
GATGCGGGTTTTACTGATGCATATACAGAGATGCTTTTTGTTCGCTTGGTTGTGATGATGTGGTGTG
GTTGGGCGGTCGTTCATTCGTTCTAGATCGGAGTAGAATACTGTTTCAAACTACCTGGTGTATTTAT
TAATTTTGGAACTGTATGTGTGTGTCATACATCTTCATAGTTACGAGTTTAAGATGGATGGAAATAT
CGATCTAGGATAGGTATACATGTTGATGTGGGTTTTACTGATGCATATACATGATGGCATATGCAGC
ATCTATTCATATGCTCTAACCTTGAGTACCTATCTATTATAATAAACAAGTATGTTTTATAATTATT
TTGATCTTGATATACTTGGATGATGGCATATGCAGCAGCTATATGTGGATTTTTTTAGCCCTGCCTT
CATACGCTATTTATTTGCTTGGTACTGTTTCTTTTGTCGATGCTCACCCTGTTGTTTGGTGTTACTT
CTGCAGG**TTTCACTGTACTTGAGAGGCTAGTAAGCAGATGCCGCAACCTCAAGACTCTGAAGCTCAA
CAATGCAATCCCTCTTGACAATGTTGCTAGCCTGCTTCGTAAGGCTCCGCAAATAATAGAACTCGGA
ACTGGCAAATTCTCTGCTGACTATCATCCAGATCTTTTTGCAAAGGTTGAAGCAGCATTTGCAGGTT
GTACAAGCCTAAGAAGGCTTTCTGGGACTTGGCACGCTGTTCCAGATTACCTGCCAGCATTCTATTG
TGTATGTGAAGGCCTCACATCTCTTAATCTGAGTTATGCCACCGTGCAAGGCCCTGAGCTCATCAAA
TTCATTAGCAGATGCAAGAATCTGCTGCAGTTATGGGTGATGGACCTCATTGAGGACCATGGTCTAT
CTGTTGTGGCATCAAGTTGCAGTAAACTGCAACACTTGCGGGTCTTCCCTTCCGATCCTTTTGGTCA
TAACGGCGGGCAAGTTTTCTTGACAGAAAGAGGTCTTG**AAAGGTATGGATAGTGTATCTTCATACTG
CATTTGTTTAATTTGAAAATGGTTATCTAGTTGCCTAACAAAATATAGCTGGGATATCTTATAACAC
ATGTGCAGGTGACATGGAAAAAAATGCCTATTTTTCTATGCACTAACTATTCATCATGTGACATACT

FIG. 65

TCCCCAAAAAACTAAATAAGCCAAATTTTCCAGCTTCCGAGTCCTGAAAAAGAGTAGTGTACCTGAT
ACAATTTATAGAGTTTTTTTTTTCGAAAAGAAGGGATAGCCCTCATAGATAGAGTACTAACTAAAAG
TCTACTTTTACCAATTTCAGGTTTTTGCAAGACCTCTTTCTGTCAAGAAAACTTGCCCGCCGTTATG
ACCAAAAGGATCGGAAGGGAAGACCCGCAACTCTTGCAGTTTACTGCAACTTGATGCCACAACAGAT
AGACCATGGTCCTCAATGAGGTCCATCACCCATAACTGCAGCAGATTCTTGCATCTGCTAATGAATT
TGATGAGCTCAGGGCCTTGCACGGTGGCATAACTCAGATTAAGAGATGTGAGGCCTTCACATACACA
ATAGAATGCTGGCAGGTAATCTGGAACAGCGTCCCAAGTCCCAGAAAGCCTTCTTAGGCTTGTACAA
CCTGCAAATGCTGCTTCAACCTTTGCAAAAAGATCTGGATGATAGTCAGCAGAGAATTTGCCAGTTC
CGAGTTCTATTATTTGCGGAGCCTTACGAAGCAGGCTACCAACATTGTCAAGAGGGATTGCATTGTT
GAGCTTCAGAGTCTTGAGGTTGCGGCATCTGCTTACTACCCTCTCAAGTACAGTGAAA*AGAAGGAGT*
*GCGTCGAAGCAGATCGTTCAAACATTTGGCAATAAAGTTTCTTAAGATTGAATCCTGTTGCCGGTCT*
*TGCGATGATTATCATATAATTTCTGTTGAATTACGTTAAGCATGTAATAATTAACATGTAATGCATG*
*ACGTTATTTATGAGATGGGTTTTTATGATTAGAGTCCCGCAATTATACATTTAATACGCGATAGAAA*
*ACAAAATATAGCGCGCAAACTAGGATAAATTATCGCGCGGTGTCATCTATGTTACTAGATCGAAC*
*CCAGCTTTCTTGTACAAAGTGGT*CCCC

FIG. 65 (cont)

LpOs05g0151300

GGGGACAAGTTTGTACAAAAAAGCAGGCT_GTGCAGCGTGACCCGGTCGTGCCCCTCTCTAGAGATAA_
_TGAGCATTGCATGTCTAAGTTATAAAAAATTACCACATATTTTTTTGTCACACTTGTTTGAAGTGC_
_AGTTTATCTATCTTTATACATATATTTAAACTTTACTCTACGAATAATATAATCTATAGTACTACAA_
_TAATATCAGTGTTTTAGAGAATCATATAAATGAACAGTTAGACATGGTCTAAAGGACAATTGAGTAT_
_TTTGACAACAGGACTCTACAGTTTTATCTTTTTAGTGTGCATGTGTTCTCCTTTTTTTTGCAAATA_
_GCTTCACCTATATAATACTTCATCCATTTTATTAGTACATCCATTTAGGGTTTAGGGTTAATGGTTT_
_TTATAGACTAATTTTTTTAGTACATCTATTTTATTCTATTTTAGCCTCTAAATTAAGAAAACTAAAA_
_CTCTATTTTAGTTTTTTTATTTAATAATTTAGATATAAAATAGAATAAAATAAAGTGACTAAAAATT_
_AAACAAATACCCTTTAAGAAATTAAAAAAACTAAGGAAACATTTTTCTTGTTTCGAGTAGATAATGC_
_CAGCCTGTTAAACGCCGTCGACGAGTCTAACGGACACCAACCAGCGAACCAGCAGCGTCGCGTCGGG_
_CCAAGCGAAGCAGACGGCACGGCATCTCTGTCGCTGCCTCTGGACCCCTCGAGAGTTCCGCTCCA_
_CCGTTGGACTTGCTCCGCTGTCGGCATCCAGAAATTGCGTGGCGGAGCGGCAGACGTGAGCCGGCAC_
_GGCAGGCGGCCTCCTCCTCCTCTCACGGCACGGCAGCTACGGGGATTCCTTTCCCACCGCTCCTTC_
_GCTTTCCCTTCCTGCCCGCCGTAATAAATAGACACCCCCTCCACACCCTCTTT_CCCCAACCTCGTG
TTGTTCGGAGCGCACACACACACAACCAGATCTCCCCCAAATCCACCCGTCGGCACCTCCGCTTCAA
GGTACGCCGCTCGTCCTCCCCCCCCCCCCCTCTCTACCTTCTCTAGATCGGCGTTCCGGTCCATGGT
TAGGGCCCGGTAGTTCTACTTCTGTTCATGTTTGTTAGATCCGTGTTTGTTAGATCCGTGCTG
CTAGCGTTCGTACACGGATGCGACCTGTACGTCAGACACGTTCTGATTGCTAACTTGCCAGTGTTTC
TCTTTGGGGAATCCTGGGATGGCTCTAGCCGTTCCGCAGACGGGATCGATTTCATGATTTTTTTTGT
TTCGTTGCATAGGGTTTGGTTTGCCCTTTTCCTTTATTTCAATATATGCCGTGCACTTGTTTGTCGG
GTCATCTTTTCATGCTTTTTTTTGTCTTGGTTGTGATGATGTGGTCTGGTTGGGCGGTCGTTCTAGA
TCGGAGTAGAATTCTGTTTCAAACTACCTGGTGGATTTATTAATTTTGGATCTGTATGTGTGTGCCA
TACATATTCATAGTTACGAATTGAAGATGATGGATGGAAATATCGATCTAGGATAGGTATACATGTT
GATGCGGGTTTTACTGATGCATATACAGAGATGCTTTTTGTTCGCTTGGTTGTGATGATGTGGTGTG
GTTGGGCGGTCGTTCATTCGTTCTAGATCGGAGTAGAATACTGTTTCAAACTACCTGGTGTATTTAT
TAATTTTGGAACTGTATGTGTGTGTCATACATCTTCATAGTTACGAGTTTAAGATGGATGGAAATAT
CGATCTAGGATAGGTATACATGTTGATGTGGGTTTTACTGATGCATATACATGATGGCATATGCAGC
ATCTATTCATATGCTCTAACCTTGAGTACCTATCTATTATAATAAACAAGTATGTTTTATAATTATT
TTGATCTTGATATACTTGGATGATGGCATATGCAGCAGCTATATGTGGATTTTTTAGCCCTGCCTT
CATACGCTATTTATTTGCTTGGTACTGTTTCTTTTGTCGATGCTCACCCTGTTGTTTGGTGTTACTT
CTGCAGGATGGCGCAGTCCGGCAGCGACGCCGCACCGATCAGCACGCACCCCACCGAGGAGGAGGAG
GTGACGGTGGAGAGGACGCCGGAGGAGGAGGCGGCCAGGCTCAGGTACCTCGAGTTCGTGCAGCAGG
CGGCGGCGCAGGCGGTCGTGCTGGCCGCCGCGGCCTACGCCTACGCCAAGCAGGGCGCGGGGCCGCT
CCGCCCCGGCGTCGACCACGTCGAGGGCACCGTCAAGGCCGTCGTCGGCCCTGTGTATGATCGGTAC
CACGCCGTGCCGCTCGACCTCCTCAAGTTCCTCGACCGCAAGAAAGGTATGGATAGTGTATCTTCAT
ACTGCATTTGTTTAATTTGAAAATGGTTATCTAGTTGCCTAACAAAATATAGCTGGGATATCTTATA
ACACATGTGCAGGTGACATGGAAAAAAATGCCTATTTTCTATGCACTAACTATTCATCATGTGACA
TACTTCCCCAAAAAACTAAATAAGCCAAATTTTCCAGCTTCCGAGTCCTGAAAAAGAGTAGTGTACC
TGATACAATTTATAGAGTTTTTTTTTTCGAAAAGAAGGGATAGCCCTCATAGATAGAGTACTAACTA
AAAGTCTACTTTTACCAATTTCAGGTTTTTGCTTGCGGTCGAGGAACTTGAGGAGGTCGAGCGGCAC
GGCGTGGTACCGATCATACACAGGGCCGACGACGGCCTTGACGGTGCCCTCGACGTGGTCGACGCCG

FIG. 66

GGGCGGAGCGGCCCCGCGCCCTGCTTGGCGTAGGCGTAGGCCCCGGCGGCCAGCACGACCGCCTGCG
CCGCCGCCTGCTGCACGAACTCGAGGTACCTGAGCCTGGCCGCCTCCTCCTCCGGCGTCCTCTCCAC
CGTCACCTCCTCCTCGGTGGGGTGCGTGCTGATCGGTGCCGCGTCGCTGCCGGACTGCGCCATA
*GAAGGAGTGCGTCGAAGCAGATCGTTCAAACATTTGGCAATAAAGTTTCTTAAGATTGAATCCTGTT*
*GCCGGTCTTGCGATGATTATCATATAATTTCTGTTGAATTACGTTAAGCATGTAATAATTAACATGT*
*AATGCATGACGTTATTTATGAGATGGGTTTTTATGATTAGAGTCCCGCAATTATACATTTAATACGC*
*GATAGAAAACAAAATATAGCGCGCAAACTAGGATAAATTATCGCGCGGTGTCATCTATGTTACTA*
*GATCGAACCCAGCTTTCTTGTACAAAGTGGT*CCCC

FIG. 66 (cont)

LpOs05g0152400

ACAAGTTTGTACAAAAAAGCAGGCTGGGG*GTGCAGCGTGACCCGGTCGTGCCCCTCTCTAGAGATAA*
*TGAGCATTGCATGTCTAAGTTATAAAAAATTACCACATATTTTTTTGTCACACTTGTTTGAAGTGC*
*AGTTTATCTATCTTTATACATATATTTAAACTTTACTCTACGAATAATATAATCTATAGTACTACAA*
*TAATATCAGTGTTTTAGAGAATCATATAAATGAACAGTTAGACATGGTCTAAAGGACAATTGAGTAT*
*TTTGACAACAGGACTCTACAGTTTTATCTTTTTAGTGTGCATGTGTTCTCCTTTTTTTTGCAAATA*
*GCTTCACCTATATAATACTTCATCCATTTTATTAGTACATCCATTTAGGGTTTAGGGTTAATGGTTT*
*TTATAGACTAATTTTTTAGTACATCTATTTTATTCTATTTTAGCCTCTAAATTAAGAAAACTAAAA*
*CTCTATTTTAGTTTTTTTATTTAATAATTTAGATATAAAATAGAATAAAATAAAGTGACTAAAAATT*
*AAACAAATACCCTTTAAGAAATTAAAAAAACTAAGGAAACATTTTTCTTGTTTCGAGTAGATAATGC*
*CAGCCTGTTAAACGCCGTCGACGAGTCTAACGGACACCAACCAGCGAACCAGCAGCGTCGCGTCGGG*
*CCAAGCGAAGCAGACGGCACGGCATCTCTGTCGCTGCCTCTGGACCCCTCTCGAGAGTTCCGCTCCA*
*CCGTTGGACTTGCTCCGCTGTCGGCATCCAGAAATTGCGTGGCGGAGCGGCAGACGTGAGCCGGCAC*
*GGCAGGCGGCCTCCTCCTCCTCTCACGGCACGGCAGCTACGGGGATTCCTTTCCCACCGCTCCTTC*
*GCTTTCCCTTCCTCGCCCGCCGTAATAAATAGACACCCCTCCACACCCTCTT*<u>*TCCCAACCTCGTG*</u>
<u>*TTGTTCGGAGCGCACACACACAACCAGATCTCCCCAAATCCACCGTCGGCACCTCCGCTTCAA*</u>
<u>G</u>GTACGCCGCTCGTCCTCCCCCCCCCCCCTCTCTACCTTCTCTAGATCGGCGTTCCGGTCCATGGT
TAGGGCCCGGTAGTTCTACTTCTGTTCATGTTTGTGTTAGATCCGTGTTTGTGTTAGATCCGTGCTG
CTAGCGTTCGTACACGGATGCGACCTGTACGTCAGACACGTTCTGATTGCTAACTTGCCAGTGTTTC
TCTTTGGGGAATCCTGGGATGGCTCTAGCCGTTCCGCAGACGGGATCGATTTCATGATTTTTTTGT
TTCGTTGCATAGGGTTTGGTTTGCCCTTTTCCTTTATTTCAATATATGCCGTGCACTTGTTTGTCGG
GTCATCTTTTCATGCTTTTTTTTGTCTTGGTTGTGATGATGTGGTCTGGTTGGGCGGTCGTTCTAGA
TCGGAGTAGAATTCTGTTTCAAACTACCTGGTGGATTTATTAATTTTGGATCTGTATGTGTGTGCCA
TACATATTCATAGTTACGAATTGAAGATGATGGATGGAAATATCGATCTAGGATAGGTATACATGTT
GATGCGGGTTTTACTGATGCATATACAGAGATGCTTTTTGTTCGCTTGGTTGTGATGATGTGGTGTG
GTTGGGCGGTCGTTCATTCGTTCTAGATCGGAGTAGAATACTGTTTCAAACTACCTGGTGTATTTAT
TAATTTTGGAACTGTATGTGTGTGTCATACATCTTCATAGTTACGAGTTTAAGATGGATGGAAATAT
CGATCTAGGATAGGTATACATGTTGATGTGGGTTTTACTGATGCATATACATGATGGCATATGCAGC
ATCTATTCATATGCTCTAACCTTGAGTACCTATCTATTATAATAAACAAGTATGTTTATAATTATT
TTGATCTTGATATACTTGGATGATGGCATATGCAGCAGCTATATGTGGATTTTTTAGCCCTGCCTT
CATACGCTATTTATTTGCTTGGTACTGTTTCTTTTGTCGATGCTCACCCTGTTGTTTGGTGTTACTT
CTGCAGG<u>TCTCCATGGGTTATTCTAAATCGGCGGTTTATAGAGTATTGTATTCTTGGCTGGGAGAAT</u>
<u>CTTCCTCGGGTTCTTCTCATGTACTTCAACAACGTAGTGCTGCCTCAGGAAGGATACTTCCACTCAG</u>
<u>TCATATGCAACTCGGTTGATTTCCGTAATTCCACTGTGAACAATGATTTGAGGTACAAGGTGTGGA</u>
<u>TGAACCACCTCAGACAGAGCCCTATTTCTGAACATGGCACATTATGATGAGATGGTGAACAGCGGA</u>
<u>CAGCCTTTTGCAAGGCGTTTTCAGAAGAAGGAACCATTGCTGGACAAGATCGATGACAAACTACTCA</u>
<u>GGCGTCCTGGGCATGGGCCTGTTCCTGGTGCC</u>AAAGGTATGGATAGTGTATCTTCATACTGCATTTG
TTTAATTTGAAAATGGTTATCTAGTTGCCTAACAAAATATAGCTGGGATATCTTATAACACATGTGC
AGGTGACATGGAAAAAAATGCCTATTTTCTATGCACTAACTATTCATCATGTGACATACTTCCCCA
AAAAACTAAATAAGCCAAATTTTCCAGCTTCCGAGTCCTGAAAAAGAGTAGTGTACCTGATACAATT
TATAGAGTTTTTTTTTTCGAAAGAAGGGATAGCCCTCATAGATAGAGTACTAACTAAAAGTCTACT
TTTACCAATTTCAGGTTTTTG<u>GGCACCAGGAACAGGCCCATGCCCAGGACGCCTGAGTAGTTTGTCA</u>

FIG. 67

TCGATCTTGTCCAGCAATGGTTCCTTCTTCTGAAAACGCCTTGCAAAAGGCTGTCCGCTGTTCACCA
TCTCATCATAATGTGCCATGTTCAGAAATAGGGGCTCTGTCTGAGGTGGTTCATCCCACACCTTGTA
CCTCAAATCATTGTTCACAGTGGAATTACGGAAATCAACCGAGTTGCATATGACTGAGTGGAAGTAT
CCTTCCTGAGGCAGCACTACGTTGTTGAAGTACATGAAGAACCCGAGGAAGATTCTCCCAGCCAA
GAATACAATACTCTATAAACCGCCGATTTAGAATAACCCATGGAGA*AGAAGGAGTGCGTCGAAGCAG*
*ATCGTTCAAACATTTGGCAATAAAGTTTCTTAAGATTGAATCCTGTTGCCGGTCTTGCGATGATTAT*
*CATATAATTTCTGTTGAATTACGTTAAGCATGTAATAATTAACATGTAATGCATGACGTTATTTATG*
*AGATGGGTTTTTATGATTAGAGTCCCGCAATTATACATTTAATACGCGATAGAAAACAAAATATAGC*
*GCGCAAACTAGGATAAATTATCGCGCGGTGTCATCTATGTTACTAGATCGA*ACCCAGCTTTCTTG
TACAAAGTGGTCCCC

FIG. 67 (cont)

LpOs06g0680500 - Glutamate

GGGGACAAGT TTGTACAAAA AAGCAGGCTG TGCAGCCTGA CCCGGTCGTG
CCCCTCTCTA GAGATAATGA GCATTGCATG TCTAAGTTAT AAAAAATTAC
CACATATTTT TTTTGTCACA CTTGTTTGAA GTGCAGTTTA TCTATCTTTA
TACATATATT TAAACTTTAC TCTACGAATA ATATAATCTA TAGTACTACA
ATAATATCAG TGTTTTAGAG AATCATATAA ATGAACAGTT AGACATGGTC
TAAAGGACAA TTGAGTATTT TGACAACAGG ACTCTACAGT TTTATCTTTT
TAGTGTGCAT GTGTTCTCCT TTTTTTTTGC AAATAGCTTC ACCTATATAA
TACTTCATCC ATTTTATTAG TACATCCATT TAGGGTTTAG GGTTAATGGT
TTTTATAGAC TAATTTTTTT AGTACATCTA TTTTATTCTA TTTTAGCCTC
TAAATTAAGA AAACTAAAAC TCTATTTTAG TTTTTTTATT TAATAATTTA
GATATAAAAT AGAATAAAAT AAAGTGACTA AAAATTAAAC AAATACCCTT
TAAGAAATTA AAAAAACTAA GGAAACATTT TTCTTGTTTC GAGTAGATAA
TGCCAGCCTG TTAAACGCCG TCGACGAGTC TAACGGACAC CAACCAGCGA
ACCAGCAGCG TCGCGTCGGG CCAAGCGAAG CAGACGGCAC GGCATCTCTG
TCGCTGCCTC TGGACCCCTC TCGAGAGTTC CGCTCCACCG TTGGACTTGC
TCCGCTGTCG GCATCCAGAA ATTGCGTGGC GGAGCGGCAG ACGTGAGCCG
GCACGGCAGG CGGCCTCCTC CTCCTCTCAC GGCACGGCAG CTACGGGGA
TTCCTTTCCC ACCGCTCCTT CGCTTTCCCT TCCTCGCCCG CCGTAATAAA
TAGACACCCC CTCCACACCC TCTTTCCCCA ACCTCGTGTT GTTCGGAGCG
CACACACACA CAACCAGATC TCCCCCAAAT CCACCCGTCG GCACCTCCGC
TTCAAGGTAC GCCGCTCGTC CTCCCCCCCC CCCCCTCTCT ACCTTCTCTA
GATCGGCGTT CCGGTCCATG GTTAGGGCCC GGTAGTTCTA CTTCTGTTCA
TGTTTGTGTT AGATCCGTGT TTGTGTTAGA TCCGTGCTGC TAGCGTTCGT
ACACGGATGC GACCTGTACG TCAGACACGT TCTGATTGCT AACTTGCCAG
TGTTTCTCTT TGGGGAATCC TGGGATGGCT CTAGCCGTTC CGCAGACGGG
ATCGATTTCA TGATTTTTTT TGTTTCGTTG CATAGGGTTT GGTTTGCCCT
TTTCCTTTAT TTCAATATAT GCCGTGCACT TGTTTGTCGG GTCATCTTTT
CATGCTTTTT TTTGTCTTGG TTGTGATGAT GTGGTCTGGT TGGGCGGTCG
TTCTAGATCG GAGTAGAATT CTGTTCAAA CTACCTGGTG GATTTATTAA
TTTTGGATCT GTATGTGTGT GCCATACATA TTCATAGTTA CGAATTGAAG
ATGATGGATG GAAATATCGA TCTAGGATAG GTATACATGT TGATGCGGGT
TTTACTGATG CATATACAGA GATGCTTTTT GTTCGCTTGG TTGTGATGAT
GTGGTGTGGT TGGGCGGTCG TTCATTCGTT CTAGATCGGA GTAGAATACT
GTTTCAAACT ACCTGGTGTA TTTATTAATT TTGGAACTGT ATGTGTGTGT
CATACATCTT CATAGTTACG AGTTTAAGAT GGATGGAAAT ATCGATCTAG
GATAGGTATA CATGTTGATG TGGGTTTTAC TGATGCATAT ACATGATGGC
ATATGCAGCA TCTATTCATA TGCTCTAACC TTGAGTACCT ATCTATTATA
ATAAACAAGT ATGTTTTATA ATTATTTTGA TCTTGATATA CTTGGATGAT
GGCATATGCA GCAGCTATAT GTGGATTTTT TTAGCCCTGC CTTCATACGC
TATTTATTTG CTTGGTACTG TTTCTTTTGT CGATGCTCAC CCTGTTGTTT
GGTGTTACTT CTGCAGGCAA TCCAGACATA GCCACCGGTC ATCATCTGGA
GCTCGTTAGC TATAGAAAAT AATCGCAGCC CTGTATCAGG ATTGACATGC

FIG. 68

```
ACAACCAGAA CCCTTGATTC CATCATGTTA ACTTTAAACA GTATATCACT
GATCACATCT TTGTTCGCAT CTGGAGGAAT TACTGCTTTA TATGAAATTC
TGGCACGCTT TGTTGCAAGG GCATCACCAA GGGCAGACAC CCCACCTCTC
CCATAATCAT CATCAACAAA TATAGCAGTT ACCTCTTTCC ATTGATAGTA
GTAAGCAATG CTAGCAATCG CACGCATTTG GAAGTAATCG CTGACAGTGC
TCCTTAAAAA GTAAGAATAC TCCGATGCAG AAAGAGTTGG ATCAGTGGCT
GCGAATGATA GGAGCGGAAC ATGCAGCTCA TTAACAAAAT GTGAGATGAC
ATGGCCTATC ACAGAGGACT GCGGGCCAAC AACTGCAACC ACATTTTCT
```

**CAAAGGTATG GATAGTGTAT CTTCATACTG CATTTGTTTA ATTTGAAAAT
GGTTATCTAG TTGCCTAACA AAATATAGCT GGGATATCTT ATAACACATG
TGCAGGTGAC ATGGAAAAAA ATGCCTATTT TTCTATGCAC TAACTATTCA
TCATGTGACA TACTTCCCCA AAAAACTAAA TAAGCCAAAT TTTCCAGCTT
CCGAGTCCTG AAAAAGAGTA GTGTACCTGA TACAATTTAT AGAGTTTTTT
TTTTCGAAAA GAAGGGATAG CCCTCATAGA TAGAGTACTA ACTAAAAGTC
TACTTTTACC AATTTCAGGT TTTTG**AGAA AAATGTGGTT GCAGTTGTTG

```
GCCCGCAGTC CTCTGTGATA GGCCATGTCA TCTCACATTT TGTTAATGAG
CTGCATGTTC CGCTCCTATC ATTCGCAGCC ACTGATCCAA CTCTTTCTGC
ATCGGAGTAT TCTTACTTTT TAAGGAGCAC TGTCAGCGAT TACTTCCAAA
TGCGTGCGAT TGCTAGCATT GCTTACTACT ATCAATGGAA AGAGGTAACT
GCTATATTTG TTGATGATGA TTATGGGAGA GGTGGGGTGT CTGCCCTTGG
TGATGCCCTT GCAACAAAGC GTGCCAGAAT TTCATATAAA GCAGTAATTC
CTCCAGATGC GAACAAAGAT GTGATCAGTG ATATACTGTT TAAAGTTAAC
ATGATGGAAT CAAGGGTTCT GGTTGTGCAT GTCAATCCTG ATACAGGGCT
GCGATTATTT TCTATAGCTA ACGAGCTCCA GATGATGACC GGTGGCTATG
TCTGGATTG*A GAAGGAGTGC GTCGAAGCAG ATCGTTCAAA CATTTGGCAA*
*TAAAGTTTCT TAAGATTGAA TCCTGTTGCC GGTCTTGCGA TGATTATCAT
ATAATTTCTG TTGAATTACG TTAAGCATGT AATAATTAAC ATGTAATGCA
TGACGTTATT TATGAGATGG GTTTTATGA TTAGAGTCCC GCAATTATAC
ATTTAATACG CGATAGAAAA CAAAATATAG CGCGCAAACT AGGATAAATT
ATCGCGCGCG GTGTCATCTA TGTTACTAGA TCGAACCCAG CTTTCTTGTA
CAAAGTGGTC* CCC
```

FIG. 68 (cont)

LpOs05g0152900- SIAH

```
GGGGACAAGT TTGTACAAAA AAGCAGGCTG TGCAGCGTGA CCCGGTCGTG
CCCCTCTCTA GAGATAATGA GCATTGCATG TCTAAGTTAT AAAAAATTAC
CACATATTTT TTTTGTCACA CTTGTTGAA GTGCAGTTTA TCTATCTTTA
TACATATATT TAAACTTTAC TCTACGAATA ATATAATCTA TAGTACTACA
ATAATATCAG TGTTTTAGAG AATCATATAA ATGAACAGTT AGACATGGTC
TAAAGGACAA TTGAGTATTT TGACAACAGG ACTCTACAGT TTTATCTTTT
TAGTGTGCAT GTGTTCTCCT TTTTTTTTGC AAATAGCTTC ACCTATATAA
TACTTCATCC ATTTTATTAG TACATCCATT TAGGGTTTAG GGTTAATGGT
TTTTATAGAC TAATTTTTTT AGTACATCTA TTTTATTCTA TTTTAGCCTC
TAAATTAAGA AAACTAAAAC TCTATTTTAG TTTTTTTATT TAATAATTTA
GATATAAAAT AGAATAAAAT AAAGTGACTA AAAATTAAAC AAATACCCTT
TAAGAAATTA AAAAAACTAA GGAAACATTT TTCTTGTTTC GAGTAGATAA
TGCCAGCCTG TTAAACGCCG TCGACGAGTC TAACGGACAC CAACCAGCGA
ACCAGCAGCG TCGCGTCGGG CCAAGCGAAG CAGACGGCAC GGCATCTCTG
TCGCTGCCTC TGGACCCCTC TCGAGAGTTC CGCTCCACCG TTGGACTTGC
TCCGCTGTCG GCATCCAGAA ATTGCGTGGC GGAGCGGCAG ACGTGAGCCG
GCACGGCAGG CGGCCTCCTC CTCCTCTCAC GGCACGGCAG CTACGGGGGA
TTCCTTTCCC ACCGCTCCTT CGCTTTCCCT TCCTCGCCCG CCCTAATAAA
TAGACACCCC CTCCACACCC TCTTTCCCCA ACCTCGTGTT GTTCGGAGCG
CACACACACA CAACCAGATC TCCCCCAAAT CCACCCGTCG GCACCTCCGC
TTCAAGGTAC GCCGCTCGTC CTCCCCCCCC CCCCCTCTCT ACCTTCTCTA
GATCGGCGTT CCGGTCCATG GTTAGGGCCC GGTAGTTCTA CTTCTGTTCA
TGTTTGTGTT AGATCCGTGT TTGTGTTAGA TCCGTGCTGC TAGCGTTCGT
ACACGGATGC GACCTGTACG TCAGACACGT TCTGATTGCT AACTTGCCAG
TGTTTCTCTT TGGGGAATCC TGGGATGGCT CTAGCCGTTC CGCAGACGGG
ATCGATTTCA TGATTTTTTT TGTTTCGTTG CATAGGGTTT GGTTTGCCCT
TTTCCTTTAT TTCAATATAT GCCGTGCACT TGTTTGTCGG GTCATCTTTT
CATGCTTTTT TTTGTCTTGG TTGTGATGAT GTGGTCTGGT TGGGCGGTCG
TTCTAGATCG GAGTAGAATT CTGTTTCAAA CTACCTGGTG GATTTATTAA
TTTTGGATCT GTATGTGTGT GCCATACATA TTCATAGTTA CGAATTGAAG
ATGATGGATG GAAATATCGA TCTAGGATAG GTATACATGT TGATGCGGGT
TTTACTGATG CATATACAGA GATGCTTTTT GTTCGCTTGG TTGTGATGAT
GTGGTGTGGT TGGGCGGTCG TTCATTCGTT CTAGATCGGA GTAGAATACT
GTTTCAAACT ACCTGGTGTA TTTATTAATT TTGGAACTGT ATGTGTGTGT
CATACATCTT CATAGTTACG AGTTTAAGAT GGATGGAAAT ATCGATCTAG
GATAGGTATA CATGTTGATG TGGGTTTTAC TGATGCATAT ACATGATGGC
ATATGCAGCA TCTATTCATA TGCTCTAACC TTGAGTACCT ATCTATTATA
ATAAACAAGT ATGTTTATA ATTATTTTGA TCTTGATATA CTTGGATGAT
GGCATATGCA GCAGCTATAT GTGGATTTTT TTAGCCCTGC CTTCATACGC
TATTTATTTG CTTGGTACTG TTTCTTTTGT CGATGCTCAC CCTGTTGTTT
GGTGTTACTT CTGCAGGTCA TAGTAGACCG GCTTGGCGGC GCAGCCGTAG
GCGGCGTTGG AGCAAGGCAC CCGGATGGAC TCCAGCAGCT TCTCCATGTC
GTGGTTCCGG TGGTATCCGC CGGAAGTCGC CGTGCGACAC ACATGGCACC
TCCGAGCCGC CCCCAGCTTG TCTCGGCACG TCAGCACAC CACGTGCCCC
ACCTTACACT GCAAGCGCGG AGACATGAGA CGATGAGCCC TTGTTCGCAT
GGTTGACATC ATTTTGCATA TGTTAATTAC CTGGAAGATG GGCGGCTTGA
```

FIG. 69

```
GTGGTAGGCA GCAAAGGCGG CAGTCGAGGG CGTCGGTGTT GTCTAAAGTC
ACGCCGTGGA GTGCCGCTGC CGCGCGTGTA GACGCCGGTG CCATTGTTTC
TACTTGACTG TCCAGGAAAA GGTATGGATA GTGTATCTTC ATACTGCATT
TGTTTAATTT GAAAATGGTT ATCTAGTTGC CTAACAAAAT ATAGCTGGGA
TATCTTATAA CACATGTGCA GGTGACATGG AAAAAAATGC CTATTTTTCT
ATGCACTAAC TATTCATCAT GTGACATACT TCCCCAAAAA ACTAAATAAG
CCAAATTTTC CAGCTTCCGA GTCCTGAAAA AGAGTAGTGT ACCTGATACA
ATTTATAGAG TTTTTTTTTT CGAAAAGAAG GGATAGCCCT CATAGATAGA
GTACTAACTA AAAGTCTACT TTTACCAATT TCAGGTTTTT GTCCTGGACA
GTCAAGTAGA AACAATGGCA CCGGCGTCTA CACGCGCGGC AGCGGCACTC
CACGGCGTGA CTTTAGACAA CACCGACGCC CTCGACTGCC GCCTTTGCTG
CCTACCACTC AAGCCGCCCA TCTTCCAGGT AATTAACATA TGCAAAATGA
TGTCAACCAT GCGAACAAGG GCTCATCGTC TCATGTCTCC GCGCTTGCAG
TGTAAGGTGG GGCACGTGGT GTGCTCGACG TGCCGAGACA AGCTGGGGGC
GGCTCGGAGG TGCCATGTGT GTCGCACGGC GACTTCGGC GGATACCACC
GGAACCACGA CATGGAGAAG CTGCTGGAGT CCATCGGGT GCCTTGCTCC
AACGCCGCCT ACGGCTGCGC CGCCAAGCCG GTCTACTATG AAGAAGGAGT
GCGTCGAAGC AGATCGTTCA AACATTTGGC AATAAAGTTT CTTAAGATTG
AATCCTGTTG CCGGTCTTGC GATGATTATC ATATAATTTC TGTTGAATTA
CGTTAAGCAT GTAATAATTA ACATGTAATG CATGACGTTA TTTATGAGAT
GGGTTTTTAT GATTAGAGTC CCGCAATTAT ACATTTAATA CGCGATAGAA
AACAAAATAT AGCGCGCAAA CTAGGATAAA TTATCGCGCG CGGTGTCATC
TATGTTACTA GATCGAACCC AGCTTTCTTG TACAAAGTGG TCCCC
```

FIG. 69 (cont)

LpOs05g0153200

GGGGACAAGTTTGTACAAAAAAGCAGGCTGTGCAGCGTGACCCGGTCGTGCCCCTCTCTAGAGATAA
TGAGCATTGCATGTCTAAGTTATAAAAAATTACCACATATTTTTTTGTCACACTTGTTTGAAGTGC
AGTTTATCTATCTTTATACATATATTTAAACTTTACTCTACGAATAATATAATCTATAGTACTACAA
TAATATCAGTGTTTTAGAGAATCATATAAATGAACAGTTAGACATGGTCTAAAGGACAATTGAGTAT
TTTGACAACAGGACTCTACAGTTTTATCTTTTTAGTGTGCATGTGTTCTCCTTTTTTTTGCAAATA
GCTTCACCTATATAATACTTCATCCATTTATTAGTACATCCATTTAGGGTTTAGGGTTAATGGTTT
TTATAGACTAATTTTTTTAGTACATCTATTTTATTCTATTTTAGCCTCTAAATTAAGAAAACTAAAA
CTCTATTTTAGTTTTTTTATTTAATAATTTAGATATAAAATAGAATAAAATAAAGTGACTAAAAATT
AAACAAATACCCTTTAAGAAATTAAAAAAACTAAGGAAACATTTTTCTTGTTTCGAGTAGATAATGC
CAGCCTGTTAAACGCCGTCGACGAGTCTAACGGACACCAACCAGCGAACCAGCAGCGTCGCGTCGGG
CCAAGCGAAGCAGACGGCACGGCATCTCTGTCGCTGCCTCTGGACCCCTCTCGAGAGTTCCGCTCCA
CCGTTGGACTTGCTCCGCTGTCGGCATCCAGAAATTGCGTGGCGGAGCGGCAGACGTGAGCCGGCAC
GGCAGGCGGCCTCCTCCTCCTCTCACGGCACGGCAGCTACGGGGGATTCCTTTCCCACCGCTCCTTC
GCTTTCCTTCCTCGCCCGCCGTAATAAATAGACACCCCCTCCACACCCTCTTT<u>CCCCAACCTCGTG
TTGTTCGAGCGCACACACACACAACCAGATCTCCCCCAAATCCACCCGTCGGCACCTCCGCTTCAA
G</u>GTACGCCGCTCGTCCTCCCCCCCCCCCCTCTCTACCTTCTCTAGATCGGCGTTCCGGTCCATGGT
**TAGGGCCCGGTAGTTCTACTTCTGTTCATGTTTGTGTTAGATCCGTGTTTGTGTTAGATCCGTGCTG
CTAGCGTTCGTACACGGATGCGACCTGTACGTCAGACACGTTCTGATTGCTAACTTGCCAGTGTTTC
TCTTTGGGGAATCCTGGGATGGCTCTAGCCGTTCCGCAGACGGGATCGATTTCATGATTTTTTTGT
TTCGTTGCATAGGGTTTGGTTTGCCCTTTTCCTTTATTTCAATATATGCCGTGCACTTGTTTGTCGG
GTCATCTTTTCATGCTTTTTTTTGTCTTGGTTGTGATGATGTGGTCTGGTTGGGCGGTCGTTCTAGA
TCGGAGTAGAATTCTGTTTCAAACTACCTGGTGGATTTATTAATTTTGGATCTGTATGTGTGTGCCA
TACATATTCATAGTTACGAATTGAAGATGATGGATGGAAATATCGATCTAGGATAGGTATACATGTT
GATGCGGGTTTTACTGATGCATATACAGAGATGCTTTTTGTTCGCTTGGTTGTGATGATGTGGTGTG
GTTGGGCGGTCGTTCATTCGTTCTAGATCGGAGTAGAATACTGTTTCAAACTACCTGGTGTATTTAT
TAATTTTGGAACTGTATGTGTGTGTCATACATCTTCATAGTTACGAGTTTAAGATGGATGGAAATAT
CGATCTAGGATAGGTATACATGTTGATGTGGGTTTTACTGATGCATATACATGATGGCATATGCAGC
ATCTATTCATATGCTCTAACCTTGAGTACCTATCTATTATAATAAACAAGTATGTTTTATAATTATT
TTGATCTTGATATACTTGGATGATGGCATATGCAGCAGCTATATGTGGATTTTTTAGCCCTGCCTT
CATACGCTATTTATTTGCTTGGTACTGTTTCTTTTGTCGATGCTCACCCTGTTGTTTGGTGTTACTT
CTGCAGG**ATGGGTATCATAGTCAATATGCCTTCTGAATATGTTGGAAAAGTGCAAACCGGCTGAAG
GAGCATTTCTCACGTTTTTATCCTGTGAAAGTGCACCATGTGTACAGTAAAGGTCGCCCTACAGGAA
ATGCTATTGTTGAGTTTGGGAAGGACTTGGTTCGTTTTAGAAATGCACTAACATTTGAGAATCAATT
TGAGAAGGAAGGGCATGGGAAAATAGGCTGGCAGGAAAAACAGCATGGAGGGCCAGAGCCTTTTGGA
TGGATCGCTAGAGCAGACGATTACAATGCTCCAGGAGCAATAGGGGACTTTCTAAGAAAAAATGGTG
ATCTGAAGACGGCTGACGGTGTTGAGGATGAAGAAACAATGAAAAATAACAAACTTGTGGCCAGTTT
<u>ATCTTTTAAAGTTATTGAAACTGATATGCATATACCAGAACTTAAATCTGTGTATCAGGAGAGAACT
GCCTCACTGAAAAGAATGATGGAGCAGAGGGAACAGCAGCTACAGTCATACAATCAAGTGCGTCCTA
ATCTTCT</u>**AAAGGTATGGATAGTGTATCTTCATACTGCATTTGTTTAATTTGAAAATGGTTATCTAGT
TGCCTAACAAAATATAGCTGGGATATCTTATAACACATGTGCAGGTGACATGGAAAAAAATGCCTAT
TTTTCTATGCACTAACTATTCATCATGTGACATACTTCCCCAAAAAACTAAATAAGCCAAATTTTCC**

FIG. 70

AGCTTCCGAGTCCTGAAAAAGAGTAGTGTACCTGATACAATTTATAGAGTTTTTTTTTCGAAAAGA
AGGGATAGCCCTCATAGATAGAGTACTAACTAAAAGTCTACTTTTACCAATTTCAGGTTTTTGAGAA
GATTAGGACGCACTTGATTGTATGACTGTAGCTGCTGTTCCCTCTGCTCCATCATTCTTTTCAGTGA
GGCAGTTCTCTCCTGATACACAGATTTAAGTTCTGGTATATGCATATCAGTTTCAATAACTTTAAAA
GATAAACTGGCCACAAGTTTGTTATTTTCATTGTTCTTCATCCTCAACACCGTCAGCCGTCTTCA
GATCACCATTTTTTCTTAGAAAGTCCCCTATTGCTCCTGGAGCATTGTAATCGTCTGCTCTAGCGAT
CCATCCAAAAGGCTCTGGCCCTCCATGCTGTTTTCCTGCCAGCCTATTTTCCCATGCCCTTCCTTC
TCAAATTGATTCTCAAATGTTAGTGCATTTCTAAAACCAACCAAGTCCTTCCCAAACTCAACAATAG
CATTTCCTGTAGGGCGACCTTTACTGTACACATGGTGCACTTTCACAGGATAAAAACGTGAGAAATG
CTCCTTCAGCCGGTTTGCACTTTTTCCAACATATTCAGAAGGCATATTGACTATGATACCCAT*AGAA*
*GGAGTGCGTCGAAGCAGATCGTTCAAACATTTGGCAATAAAGTTTCTTAAGATTGAATCCTGTTGCC*
*GGTCTTGCGATGATTATCATATAATTTCTGTTGAATTACGTTAAGCATGTAATAATTAACATGTAAT*
*GCATGACGTTATTTATGAGATGGGTTTTTATGATTAGAGTCCCGCAATTATACATTTAATACGCGAT*
*AGAAAACAAAATATAGCGCGCAAACTAGGATAAATTATCGCGCGGTGTCATCTATGTTACTAGAT*
*CGAACCCAGCTTTCTTGTACAAAGTGGT*CCCC

FIG. 70 (cont)

LpOs04g0645500

GGGGACAAGTTTGTACAAAAAAGCAGGCT*GTGCAGCGTGACCCGGTCGTGCCCCTCTCTAGAGATAA*
*TGAGCATTGCATGTCTAAGTTATAAAAAATTACCACATATTTTTTTGTCACACTTGTTTGAAGTGC*
*AGTTTATCTATCTTTATACATATATTTAAACTTTACTCTACGAATAATATAATCTATAGTACTACAA*
*TAATATCAGTGTTTTAGAGAATCATATAAATGAACAGTTAGACATGGTCTAAAGGACAATTGAGTAT*
*TTTGACAACAGGACTCTACAGTTTTATCTTTTTAGTGTGCATGTGTTCTCCTTTTTTTTGCAAATA*
*GCTTCACCTATATAATACTTCATCCATTTTATTAGTACATCCATTTAGGGTTTAGGGTTAATGGTTT*
*TTATAGACTAATTTTTTAGTACATCTATTTTATTCTATTTTAGCCTCTAAATTAAGAAAACTAAAA*
*CTCTATTTTAGTTTTTTTATTTAATAATTTAGATATAAAATAGAATAAAATAAAGTGACTAAAAATT*
*AAACAAATACCCTTTAAGAAATTAAAAAAACTAAGGAAACATTTTTCTTGTTTCGAGTAGATAATGC*
*CAGCCTGTTAAACGCCGTCGACGAGTCTAACGGACACCAACCAGCGAACCAGCAGCGTCGCGTCGGG*
*CCAAGCGAAGCAGACGGCACGGCATCTCTGTCGCTGCCTCTGGACCCCTCTCGAGAGTTCCGCTCCA*
*CCGTTGGACTTGCTCCGCTGTCGGCATCCAGAAATTGCGTGGCGGAGCGGCAGACGTGAGCCGGCAC*
*GGCAGGCGGCCTCCTCCTCCTCTCACGGCACGGCAGCTACGGGGATTCCTTTCCCACCGCTCCTTC*
*GCTTTCCCTTCCTCGCCCGCCGTAATAAATAGACACCCCTCCACACCCTCTT*<u>*TCCCAACCTCGTG*</u>
<u>*TTGTTCGGAGCGCACACACACACAACCAGATCTCCCCCAAATCCACCCGTCGGCACCTCCGCTTCAA*</u>
<u>*G*</u>GTACGCCGCTCGTCCTCCCCCCCCCCCCTCTCTACCTTCTCTAGATCGGCGTTCCGGTCCATGGT
TAGGGCCCGGTAGTTCTACTTCTGTTCATGTTTGTGTTAGATCCGTGTTTGTGTTAGATCCGTGCTG
CTAGCGTTCGTACACGGATGCGACCTGTACGTCAGACACGTTCTGATTGCTAACTTGCCAGTGTTTC
TCTTTGGGGAATCCTGGGATGGCTCTAGCCGTTCCGCAGACGGGATCGATTTCATGATTTTTTTGT
TTCGTTGCATAGGGTTTGGTTTGCCCTTTTCCTTTATTTCAATATATGCCGTGCACTTGTTTGTCGG
GTCATCTTTTCATGCTTTTTTTTGTCTTGGTTGTGATGATGTGGTCTGGTTGGGCGGTCGTTCTAGA
TCGGAGTAGAATTCTGTTTCAAACTACCTGGTGGATTTATTAATTTTGGATCTGTATGTGTGCCA
TACATATTCATAGTTACGAATTGAAGATGATGGATGGAAATATCGATCTAGGATAGGTATACATGTT
GATGCGGGTTTTACTGATGCATATACAGAGATGCTTTTTGTTCGCTTGGTTGTGATGATGTGGTGTG
GTTGGGCGGTCGTTCATTCGTTCTAGATCGGAGTAGAATACTGTTTCAAACTACCTGGTGTATTTAT
TAATTTTGGAACTGTATGTGTGTGTCATACATCTTCATAGTTACGAGTTTAAGATGGATGGAAATAT
CGATCTAGGATAGGTATACATGTTGATGTGGGTTTTACTGATGCATATACATGATGGCATATGCAGC
ATCTATTCATATGCTCTAACCTTGAGTACCTATCTATTATAATAAACAAGTATGTTTTATAATTATT
TTGATCTTGATATACTTGGATGATGGCATATGCAGCAGCTATATGTGGATTTTTTAGCCCTGCCTT
CATACGCTATTTATTTGCTTGGTACTGTTTCTTTTGTCGATGCTCACCCTGTTGTTTGGTGTTACTT
CTGCAGGGTCGTGAGCAAATCTTCCTTTGGCGGCAGCGCTCCTCTGAAGAATGGTGAATTTGAGAAG
ATGCTGGAAATGGAACCGCAGAAAACCGTGGTCATAGATTTTACTGATGTGGACATCCCTGTGCTAG
AAGAGGCAAAACCGCTTATTTGTGGAATCGGTGAGTTTGGTGATGATGTTCTGAAGGAGCAACAGCT
TTCCACCAAGGAGATTGCAATTTACGGATTATATCTTTGCCCCATTTGGTTTGTCACAGAGTATTTA
TCAAATGCAGCCCTTGCAAGAACAAGTGTTGCCAGTACTACGGTACTATCTTCAACTTCGGGACTCT
TCACACTCTTCATTAGTGTGCTCCTTGGCCAAGATTCCATAAATGCTGCCAAAGTTATTGCTGTTTT
TGTTAGCATGGCTGGTGTAGCAATGACAACTATGGGCCAGACTTGGGCAACAGATGAATCTGAAGTA
<u>AGCAATTCAG</u>AAAGGTATGGATAGTGTATCTTCATACTGCATTTGTTTAATTTGAAAATGGTTATCT
AGTTGCCTAACAAAATATAGCTGGGATATCTTATAACACATGTGCAGGTGACATGGAAAAAAATGCC
TATTTTTCTATGCACTAACTATTCATCATGTGACATACTTCCCCAAAAAACTAAATAAGCCAAATTT
TCCAGCTTCCGAGTCCTGAAAAAGAGTAGTGTACCTGATACAATTTATAGAGTTTTTTTTTCGAAA

FIG. 71

AGAAGGGATAGCCCTCATAGATAGAGTACTAACTAAAAGTCTACTTTTACCAATTTCAGGTTTTTGC
TGAATTGCTTACTTCAGATTCATCTGTTGCCCAAGTCTGGCCCATAGTTGTCATTGCTACACCAGCC
ATGCTAACAAAAACAGCAATAACTTTGGCAGCATTTATGAATCTTGGCCAAGGAGCACACTAATGA
AGAGTGTGAAGAGTCCCGAAGTTGAAGATAGTACCGTAGTACTGGCAACACTTGTTCTTGCAAGGGC
TGCATTTGATAAATACTCTGTGACAAACCAAATGGGCAAAGATATAATCCGTAAATTGCAATCTCC
TTGGTGGAAAGCTGTTGCTCCTTCAGAACATCATCACCAAACTCACCGATTCCACAAATAAGCGGTT
TTGCCTCTTCTAGCACAGGGATGTCCACATCAGTAAAATCTATGACCACGGTTTTCTGCGGTTCCAT
TTCCAGCATCTTCTCAAATTCACCATTCTTCAGAGGAGCGCTGCCGCCAAAGGAAGATTTGCTCACG
AC*AGAAGGAGTGCGTCGAAGCAGATCGTTCAAACATTTGGCAATAAAGTTTCTTAAGATTGAATCCT*
*GTTGCCGGTCTTGCGATGATTATCATATAATTTCTGTTGAATTACGTTAAGCATGTAATAATTAACA*
*TGTAATGCATGACGTTATTTATGAGATGGGTTTTTATGATTAGAGTCCCGCAATTATACATTTAATA*
*CGCGATAGAAAACAAAATATAGCGCGCAAACTAGGATAAATTATCGCGCGGTGTCATCTATGTTA*
*CTAGATCGA*ACCCAGCTTTCTTGTACAAAGTGGTCCCC

FIG. 71 (cont)

LpOs04g0645600

GGGGACAAGTTTGTACAAAAAAGCAGGCTGTGCAGCGTGACCCGGTCGTGCCCCTCTCTAGAGATAA
*TGAGCATTGCATGTCTAAGTTATAAAAAATTACCACATATTTTTTTGTCACACTTGTTTGAAGTGC*
*AGTTTATCTATCTTTATACATATATTTAAACTTTACTCTACGAATAATATAATCTATAGTACTACAA*
*TAATATCAGTGTTTTAGAGAATCATATAAATGAACAGTTAGACATGGTCTAAAGGACAATTGAGTAT*
*TTTGACAACAGGACTCTACAGTTTTATCTTTTTAGTGTGCATGTGTTCTCCTTTTTTTTGCAAATA*
*GCTTCACCTATATAATACTTCATCCATTTTATTAGTACATCCATTTAGGGTTTAGGGTTAATGGTTT*
*TTATAGACTAATTTTTTAGTACATCTATTTTATTCTATTTTAGCCTCTAAATTAAGAAAACTAAAA*
*CTCTATTTTAGTTTTTTTATTTAATAATTTAGATATAAAATAGAATAAAATAAAGTGACTAAAAATT*
*AAACAAATACCCTTTAAGAAATTAAAAAAACTAAGGAAACATTTTTCTTGTTTCGAGTAGATAATGC*
*CAGCCTGTTAAACGCCGTCGACGAGTCTAACGGACACCAACCAGCGAACCAGCAGCGTCGCGTCGGG*
*CCAAGCGAAGCAGACGGCACGGCATCTCTGTCGCTGCCTCTGGACCCCTCTCGAGAGTTCCGCTCCA*
*CCGTTGGACTTGCTCCGCTGTCGGCATCCAGAAATTGCGTGGCGGAGCGGCAGACGTGAGCCGGCAC*
*GGCAGGCGGCCTCCTCCTCCTCTCACGGCACGGCAGCTACGGGGGATTCCTTTCCCACCGCTCCTTC*
*GCTTTCCCTTCCTCGCCCGCCGTAATAAATAGACACCCCCTCCACACCCTCTT*<u>*TCCCCAACCTCGTG*</u>
<u>*TTGTTCGGAGCGCACACACACACAACCAGATCTCCCCCAAATCCACCCGTCGGCACCTCCGCTTCAA*</u>
<u>*G*</u>GTACGCCGCTCGTCCTCCCCCCCCCCCCCTCTCTACCTTCTCTAGATCGGCGTTCCGGTCCATGGT
TAGGGCCCGGTAGTTCTACTTCTGTTCATGTTTGTGTTAGATCCGTGTTTGTGTTAGATCCGTGCTG
CTAGCGTTCGTACACGGATGCGACCTGTACGTCAGACACGTTCTGATTGCTAACTTGCCAGTGTTTC
TCTTTGGGGAATCCTGGGATGGCTCTAGCCGTTCCGCAGACGGGATCGATTTCATGATTTTTTTGT
TTCGTTGCATAGGGTTTGGTTTGCCCTTTTCCTTTATTTCAATATATGCCGTGCACTTGTTTGTCGG
GTCATCTTTTCATGCTTTTTTTTGTCTTGGTTGTGATGATGTGGTCTGGTTGGCGGTCGTTCTAGA
TCGGAGTAGAATTCTGTTTCAAACTACCTGGTGGATTTATTAATTTTGGATCTGTATGTGTGTGCCA
TACATATTCATAGTTACGAATTGAAGATGATGGATGGAAATATCGATCTAGGATAGGTATACATGTT
GATGCGGGTTTTACTGATGCATATACAGAGATGCTTTTTGTTCGCTTGGTTGTGATGATGTGGTGTG
GTTGGGCGGTCGTTCATTCGTTCTAGATCGGAGTAGAATACTGTTTCAAACTACCTGGTGTATTTAT
TAATTTTGGAACTGTATGTGTGTGTCATACATCTTCATAGTTACGAGTTTAAGATGGATGGAAATAT
CGATCTAGGATAGGTATACATGTTGATGTGGGTTTTACTGATGCATATACATGATGGCATATGCAGC
ATCTATTCATATGCTCTAACCTTGAGTACCTATCTATTATAATAAACAAGTATGTTTTATAATTATT
TTGATCTTGATATACTTGGATGATGGCATATGCAGCAGCTATATGTGGATTTTTTAGCCCTGCCTT
CATACGCTATTTATTTGCTTGGTACTGTTTCTTTTGTCGATGCTCACCCTGTTGTTTGGTGTTACTT
CTGCAGGCACACTCTTCATTAGTGTGCTCCTTGGCCAAGATTCCATAAATGCTGCCAAAGTTATTGC
TGTTTTTGTTAGCATGGCTGGTGTAGCAATGACAACTATGGGCCAGACTTGGGCAACAGATGAATCT
GAAGTAAGCAATTCAGGAACTTATCGCCTTGCTAACCATCTAATTCTTAAGCCTTACTACTGCAGGG
CCACACAGAGGACTCTTCTAGGTGATATGTTTGGTCTTCTGTCAGCTGTGTCATATGGTCTCTTCAC
TGTGCTTCTCAAAAAGTTTGCTGGAGGAGAAGGATCTGAAAAGGTTGATGTCCAAAAACTGTTCGGC
TTTCTCGGACTTTTCACTCTTTGTCTTCTCTGGTGGCTTGTCTGGCCATTAACTGCGCTAGGCATTG
AGCCAAAGTTTACAATGCCCCACTCAGCTAAAGTGGATGAAGTTGTTCTGGCAAATGGCCTTATTGG
GAGTGTGCTATCAGACTATTTCTGGGCTCTATCTGTTGAAAGGTATGGATAGTGTATCTTCATACTG
CATTTGTTTAATTTGAAAATGGTTATCTAGTTGCCTAACAAAATATAGCTGGGATATCTTATAACAC
ATGTGCAGGTGACATGGAAAAAAATGCCTATTTTTCTATGCACTAACTATTCATCATGTGACATACT
TCCCCAAAAAACTAAATAAGCCAAATTTTCCAGCTTCCGAGTCCTGAAAAAGAGTAGTGTACCTGAT
ACAATTTATAGAGTTTTTTTTTTCGAAAAGAAGGGATAGCCCTCATAGATAGAGTACTAACTAAAAG

FIG. 72

TCTACTTTTACCAATTTCAGGTTTTTGCAACAGATAGAGCCCAGAAATAGTCTGATAGCACACTCCC
AATAAGGCCATTTGCCAGAACAACTTCATCCACTTTAGCTGAGTGGGGCATTGTAAACTTTGGCTCA
ATGCCTAGCGCAGTTAATGGCCAGACAAGCCACCAGAGAACACAAAGAGTGAAAAGTCCGAGAAAGC
CGAACAGTTTTTGGACATCAACCTTTTCAGATCCTTCTCCTCCAGCAAACTTTTTGAGAAGCACAGT
GAAGAGACCATATGACACAGCTGACAGAAGACCAAACATATCACCTAGAAGAGTCCTCTGTGTGGCC
CTGCAGTAGTAAGGCTTAAGAATTAGATGGTTAGCAAGGCCATAAGTTCCTGAATTGCTTACTTCAG
ATTCATCTGTTGCCCAAGTCTGGCCCATAGTTGTCATTGCTACACCAGCCATGCTAACAAAAACAGC
AATAACTTTGGCAGCATTTATGGAATCTTGGCCAAGGAGCACACTAATGAAGAGTGTG*AGAAGGAGT*
*GCGTCGAAGCAGATCGTTCAAACATTTGGCAATAAAGTTTCTTAAGATTGAATCCTGTTGCCGGTCT*
*TGCGATGATTATCATATAATTTCTGTTGAATTACGTTAAGCATGTAATAATTAACATGTAATGCATG*
*ACGTTATTTATGAGATGGGTTTTTATGATTAGAGTCCCGCAATTATACATTTAATACGCGATAGAAA*
*ACAAAATATAGCGCGCAAACTAGGATAAATTATCGCGCGGTGTCATCTATGTTACTAGATCGA*AC
CCAGCTTTCTTGTACAAAGTGGTCCCC

FIG. 72 (cont)

LpOs04g0647300 – TC116908

GGGGACAAGT TTGTACAAAA AAGCAGGCTG *TGCAGCGTGA CCCGGTCGTG CCCCTCTCTA*
*GAGATAATGA GCATTGCATG TCTAAGTTAT AAAAAATTAC CACATATTTT TTTTGTCACA*
*CTTGTTTGAA GTGCAGTTTA TCTATCTTTA TACATATATT TAAACTTTAC TCTACGAATA*
*ATATAATCTA TAGTACTACA ATAATATCAG TGTTTTAGAG AATCATATAA ATGAACAGTT*
*AGACATGGTC TAAAGGACAA TTGAGTATTT TGACAACAGG ACTCTACAGT TTTATCTTTT*
*TAGTGTGCAT GTGTTCTCCT TTTTTTTTGC AAATAGCTTC ACCTATATAA TACTTCATCC*
*ATTTTATTAG TACATCCATT TAGGGTTTAG GGTTAATGGT TTTTATAGAC TAATTTTTTT*
*AGTACATCTA TTTTATTCTA TTTTAGCCTC TAAATTAAGA AAACTAAAAC TCTATTTTAG*
*TTTTTTTATT TAATAATTTA GATATAAAAT AGAATAAAAT AAAGTGACTA AAAATTAAAC*
*AAATACCCTT TAAGAAATTA AAAAAACTAA GGAAACATTT TTCTTGTTTC GAGTAGATAA*
*TGCCAGCCTG TTAAACGCCG TCGACGAGTC TAACGGACAC CAACCAGCGA ACCAGCAGCG*
*TCGCGTCGGG CCAAGCGAAG CAGACGGCAC GGCATCTCTG TCGCTGCCTC TGGACCCCTC*
*TCGAGAGTTC CGCTCCACCG TTGGACTTGC TCCGCTGTCG GCATCCAGAA ATTGCGTGGC*
*GGAGCGGCAG ACGTGAGCCG GCACGGCAGG CGGCCTCCTC CTCCTCTCAC GGCACGGCAG*
*CTACGGGGGA TTCCTTTCCC ACCGCTCCTT CGCTTTCCCT TCCTCGCCCG CCGTAATAAA*
*TAGACACCCC CTCCACACCC TCTTTCCCCA ACCTCGTGTT GTTCGGAGCG CACACACACA*
*CAACCAGATC TCCCCCAAAT CCACCCGTCG GCACCTCCGC TTCAAG*GTAC GCCGCTCGTC
**CTCCCCCCCC CCCCCTCTCT ACCTTCTCTA GATCGGCGTT CCGGTCCATG GTTAGGGCCC
GGTAGTTCTA CTTCTGTTCA TGTTTGTGTT AGATCCGTGT TTGTGTTAGA TCCGTGCTGC
TAGCGTTCGT ACACGGATGC GACCTGTACG TCAGACACGT TCTGATTGCT AACTTGCCAG
TGTTTCTCTT TGGGGAATCC TGGGATGGCT CTAGCCGTTC CGCAGACGGG ATCGATTTCA
TGATTTTTTT TGTTTCGTTG CATAGGGTTT GGTTTGCCCT TTTCCTTTAT TTCAATATAT
GCCGTGCACT TGTTTGTCGG GTCATCTTTT CATGCTTTTT TTTGTCTTGG TTGTGATGAT
GTGGTCTGGT TGGGCGGTCG TTCTAGATCG GAGTAGAATT CTGTTTCAAA CTACCTGGTG
GATTTATTAA TTTTGGATCT GTATGTGTGT GCCATACATA TTCATAGTTA CGAATTGAAG
ATGATGGATG GAAATATCGA TCTAGGATAG GTATACATGT TGATGCGGGT TTTACTGATG
CATATACAGA GATGCTTTTT GTTCGCTTGG TTGTGATGAT GTGGTGTGGT TGGGCGGTCG
TTCATTCGTT CTAGATCGGA GTAGAATACT GTTTCAAACT ACCTGGTGTA TTTATTAATT
TTGGAACTGT ATGTGTGTGT CATACATCTT CATAGTTACG AGTTTAAGAT GGATGGAAAT
ATCGATCTAG GATAGGTATA CATGTTGATG TGGGTTTTAC TGATGCATAT ACATGATGGC
ATATGCAGCA TCTATTCATA TGCTCTAACC TTGAGTACCT ATCTATTATA ATAAACAAGT
ATGTTTTATA ATTATTTTGA TCTTGATATA CTTGGATGAT GGCATATGCA GCAGCTATAT
GTGGATTTTT TTAGCCCTGC CTTCATACGC TATTTATTTG CTTGGTACTG TTTCTTTTGT
CGATGCTCAC CCTGTTGTTT GGTGTTACTT CTGCAGG**GGA GCGCACGCCA TACAGCCCCG
CCAAGTTCCT CTATAGGTCC GGATCTCAAG CTCTATTTGC ATTGGTTGAT GCAGCGCTGT

GATTTCAGCA ACGTGCTGTT TTTTTTTCAA TGCTGGGTTC GTTGCGTATT AGGGAAGTTA
GCCGTTAGTT AAATGGCTGT GTCAAGTATT GTAACTGTGG AAGCAGGTC TTGTTTGAGA
CAGTATACTG TATATTCTCT CCTGCAAAAG ATAGAGTAAT CTTTCTATGC TATTCCATGG
AACTAAGTTA GATCATGCAG ATTGCAAGTC TACTTAACAT GATATGGAAT GATGTGAACA
GAGATATATC ACTAAAAGGG GCAAGGTTTG CTTAGTGGGA GCTGCTACTG GGGGGAAATG
GTTGCACGTT TGCATTTCTA TGGCCTGTTT GAGGAAATCC CCTCGTATAT AAAGCATGTA
TAGAGTTAAG TTCTTATGTT TTCATTTGAT TCTGCAAGTA CTCTTGGCA**A AAGGTATGGA
TAGTGTATCT TCATACTGCA TTTGTTTAAT TTGAAAATGG TTATCTAGTT GCCTAACAAA
ATATAGCTGG GATATCTTAT AACACATGTG CAGGTGACAT GGAAAAAAAT GCCTATTTTT
CTATGCACTA ACTATTCATC ATGTGACATA CTTCCCCAAA AAACTAAATA AGCCAAATTT**

FIG. 73

```
TCCAGCTTCC GAGTCCTGAA AAAGAGTAGT GTACCTGATA CAATTTATAG AGTTTTTTTT
TTCGAAAAGA AGGGATAGCC CTCATAGATA GAGTACTAAC TAAAAGTCTA CTTTTACCAA
TTTCAGGTTT TTGTCCCAAC ACTACTTGCA GAATCAAATG AAAACATAAG AACTTAACTC
TATACATGCT TTATATACGA GGGGATTTCC TCAAACAGGC CATAGAAATG CAAACGTGCA
ACCATTTCCC CCCAGTAGCA GCTCCCACTA AGCAAACCTT GCCCCTTTTA GTGATATATC
TCTGTTCACA TCATTCCATA TCATGTTAAG TAGACTTGCA ATCTGCATGA TCTAACTTAG
TTCCATGGAA TAGCATAGAA AGATTACTCT ATCTTTTGCA GGAGAGAATA TACAGTATAC
TGTCTCAAAC AAGACCTGCT TCCCACAGTT ACAATACTTG ACACAGCCAT TTAACTAACG
GCTAACTTCC CTAATACGCA ACGAACCCAG CATTGAAAAA AAAACAGCAC GTTGCTGAAA
TCACAGCGCT GCATCAACCA ATGCAAATAG AGCTTGAGAT CCGGACCTAT AGAGGAACTT
GGCGGGGCTG TATGGCGTGC GCTCCAGAAG GAGTGCGTCG AAGCAGATCG TTCAAACATT
TGGCAATAAA GTTTCTTAAG ATTGAATCCT GTTGCCGGTC TTGCGATGAT TATCATATAA
TTTCTGTTGA ATTACGTTAA GCATGTAATA ATTAACATGT AATGCATGAC GTTATTTATG
AGATGGGTTT TTATGATTAG AGTCCCGCAA TTATACATTT AATACGCGAT AGAAAACAAA
ATATAGCGCG CAAACTAGGA TAAATTATCG CGCGCGGTGT CATCTATGTT ACTAGATCGA
ACCCAGCTTT CTTGTACAAA GTGGTCCCC
```

FIG. 73 (cont)

LpOs03g0193400

GGGGACAAGTTTGTACAAAAAAGCAGGCTGTGCAGCGTGACCCGGTCGTGCCCCTCTCTAGAGATAA
TGAGCATTGCATGTCTAAGTTATAAAAAATTACCACATATTTTTTTGTCACACTTGTTTGAAGTGC
AGTTTATCTATCTTTATACATATATTTAAACTTTACTCTACGAATAATATAATCTATAGTACTACAA
TAATATCAGTGTTTTAGAGAATCATATAAATGAACAGTTAGACATGGTCTAAAGGACAATTGAGTAT
TTTGACAACAGGACTCTACAGTTTTATCTTTTTAGTGTGCATGTGTTCTCCTTTTTTTTGCAAATA
GCTTCACCTATATAATACTTCATCCATTTTATTAGTACATCCATTTAGGGTTTAGGGTTAATGGTTT
TTATAGACTAATTTTTTAGTACATCTATTTTATTCTATTTTAGCCTCTAAATTAAGAAAACTAAAA
CTCTATTTTAGTTTTTTTATTTAATAATTTAGATATAAAATAGAATAAAATAAAGTGACTAAAAATT
AAACAAATACCCTTTAAGAAATTAAAAAAACTAAGGAAACATTTTTCTTGTTTCGAGTAGATAATGC
CAGCCTGTTAAACGCCGTCGACGAGTCTAACGGACACCAACCAGCGAACCAGCAGCGTCGCGTCGGG
CCAAGCGAAGCAGACGGCACGGCATCTCTGTCGCTGCCTCTGGACCCCTCTCGAGAGTTCCGCTCCA
CCGTTGGACTTGCTCCGCTGTCGGCATCCAGAAATTGCGTGGCGGAGCGGCAGACGTGAGCCGGCAC
GGCAGGCGGCCTCCTCCTCCTCTCACGGCACGGCAGCTACGGGGATTCCTTTCCCACCGCTCCTTC
GCTTTCCCTTCCTCGCCCGCCGTAATAAATAGACACCCCTCCACACCCTCTTT<u>CCCCAACCTCGTG
TTGTTCGGAGCGCACACACACACAACCAGATCTCCCCAAATCCACCGTCGGCACCTCCGCTTCAA
G</u>GTACGCCGCTCGTCCTCCCCCCCCCCCCCTCTCTACCTTCTCTAGATCGGCGTTCCGGTCCATGGT
**TAGGGCCCGGTAGTTCTACTTCTGTTCATGTTTGTGTTAGATCCGTGTTTGTGTTAGATCCGTGCTG
CTAGCGTTCGTACACGGATGCGACCTGTACGTCAGACACGTTCTGATTGCTAACTTGCCAGTGTTTC
TCTTTGGGGAATCCTGGGATGGCTCTAGCCGTTCCGCAGACGGGATCGATTTCATGATTTTTTTTGT
TTCGTTGCATAGGGTTTGGTTTGCCCTTTTCCTTTATTTCAATATATGCCGTGCACTTGTTTGTCGG
GTCATCTTTTCATGCTTTTTTTGTCTTGGTTGTGATGATGTGGTCTGGTTGGGCGGTCGTTCTAGA
TCGGAGTAGAATTCTGTTTCAAACTACCTGGTGGATTTATTAATTTTGGATCTGTATGTGTGTGCCA
TACATATTCATAGTTACGAATTGAAGATGATGGATGGAAATATCGATCTAGGATAGGTATACATGTT
GATGCGGGTTTTACTGATGCATATACAGAGATGCTTTTTGTTCGCTTGGTTGTGATGATGTGGTGTG
GTTGGGCGGTCGTTCATTCGTTCTAGATCGGAGTAGAATACTGTTTCAAACTACCTGGTGTATTTAT
TAATTTTGGAACTGTATGTGTGTGTCATACATCTTCATAGTTACGAGTTTAAGATGGATGGAAATAT
CGATCTAGGATAGGTATACATGTTGATGTGGGTTTTACTGATGCATATACATGATGGCATATGCAGC
ATCTATTCATATGCTCTAACCTTGAGTACCTATCTATTATAATAAACAAGTATGTTTTATAATTATT
TTGATCTTGATATACTTGGATGATGGCATATGCAGCAGCTATATGTGGATTTTTTAGCCCTGCCTT
CATACGCTATTTATTTGCTTGGTACTGTTTCTTTTGTCGATGCTCACCCTGTTGTTTGGTGTTACTT
CTGCAGG**<u>ATGGGCAGGCGAGGCGGCGTGTTGTTTGTGGTGGGGGAGGAGACGGCGTGGCGAGGAGG
CGGGATGGGGAGGCGGCGCCGCGAGGAGGAGGGGATGGGGGCGCCGGGGACGGATGCGTGCTGGGGA
GGGGGAGCGATGGGTTTCTGCGAGAGGAGAATAGTGGAGGCGGGATCGCTAATTACATGGTGGTAGA
CTACTACCTGTATGACTACGAGTACGCCGAGCCGCCGCGCGTGACCAGCCTGCAGAACGCCGTTCCC
CAGAGGACCTTCAGCGACTTCGGAGATGACGTCTACTTCGTCGCCGACAAACGGGGCTACGAGTCCG
TCGTCCACTACCTCGCCGGCCAGTACCTCAACACCGACGACTCCGGCAACGTCGCCGACCCCCGCCT
GCAGCTCAACAAGGTGGTGCGAGAGATCTCCTACTCCTCGAGCGGAGTCACCGTCAAGACGGAGGAC
GGCTCAGTGTACCAGGCAGACTATCGTCATGCATGGAAATCATCGCCATCTACCGGTTCGACATGG
CAGTGTACACCAAGATCTTCCTCAAGTTCCCTCGGAAGTTCTGGCCCACGGGCGAAGGCAAGCAGTT
CTTCGTCTACGCCAGCTCCAGGCGAGGCTACTACCGGATGTGGCAGTCCTTCGAGGAGGAGTACCCG
GGGGCCAACGTGCTCCTCGTGACGGTGACGGACCAGGAGTCGCGGCGGATCGAGCAGCAGCCGGACA</u>

FIG. 74

ACACCACCATGGCGGAGGCTGTGGCGGTGCTGCGGAGGATGTTCCCCGACGAGGACGTCCCCGACGC
CACCGATATCTACGTGCCCAGGTGGTGGTCCAACCGCTTCTTCAAGGGCTCCTACTCCAACTGGCCC
ATCGGCGTCAACCGCTACGAATACGACCAGCTTCGG**AAAGGTATGGATAGTGTATCTTCATACTGCA
TTTGTTTAATTTGAAAATGGTTATCTAGTTGCCTAACAAAATATAGCTGGGATATCTTATAACACAT
GTGCAGGTGACATGGAAAAAAATGCCTATTTTTCTATGCACTAACTATTCATCATGTGACATACTTC
CCCAAAAAACTAAATAAGCCAAATTTTCCAGCTTCCGAGTCCTGAAAAAGAGTAGTGTACCTGATAC
AATTTATAGAGTTTTTTTTTTCGAAAAGAAGGGATAGCCCTCATAGATAGAGTACTAACTAAAAGTC
TACTTTTACCAATTTCAGGTTTTTG**CCGAAGCTGGTCGTATTCGTAGCGGTTGACGCCGATGGGCCA
GTTGGAGTAGGAGCCCTTGAAGAAGCGGTTGGACCACCACCTGGGCACGTAGATATCGGTGGCGTCG
GGGACGTCCTCGTCGGGAACATCCTCCGCAGCACCGCCACAGCCTCCGCCATGGTGGTGTTGTCCG
GCTGCTGCTCGATCCGCCGCGACTCCTGGTCCGTCACCGTCACGAGGAGCACGTTGGCCCCCGGGTA
CTCCTCCTCGAAGGACTGCCACATCCCGTAGTAGCCTCGCCTGGAGCTGGCGTAGACGAAGAACTGC
TTGCCTTCGCCCGTGGGCCAGAACTTCCGAGGGAACTTGAGGAAGATCTTGGTGTACACTGCCATGT
CGAACCGGTAGATGGCGATGATTTTCCATGCATGACGATAGTCTGCCTGGTACACTGAGCCGTCCTC
CGTCTTGACGGTGACTCCGCTCGAGGAGTAGGAGATCTCTCGCACCACCTTGTTGAGCTGCAGGCGG
GGGTCGGCGACGTTGCCGGAGTCGTCGGTGTTGAGGTACTGGCCGGCGAGGTAGTGGACGACGGACT
CGTAGCCCCGTTTGTCGGCGACGAAGTAGACGTCATCTCCGAAGTCGCTGAAGGTCCTCTGGGGAAC
GGCGTTCTGCAGGCTGGTCACGCGCGGCGGCTCGGCGTACTCGTAGTCATACAGGTAGTAGTCTACC
ACCATGTAATTAGCGATCCCGCCTCCACTATTCTCCTCTCGCAGAAACCCATCGCTCCCCCTCCCCA
GCACGCATCCGTCCCCGGCGCCCCCATCCCCTCCTCCTCGCGGCGCCGCCTCCCCATCCCGCCTCCT
CGCCACGCCGTCTCCTCCCCCCACCACAAACAACACGCCGCCTCGCCTGCCCAT***AGAAGGAGTGCGT
CGAAGCAGATCGTTCAAACATTTGGCAATAAAGTTTCTTAAGATTGAATCCTGTTGCCGGTCTTGCG
ATGATTATCATATAATTTCTGTTGAATTACGTTAAGCATGTAATAATTAACATGTAATGCATGACGT
TATTTATGAGATGGGTTTTTATGATTAGAGTCCCGCAATTATACATTTAATACGCGATAGAAAACAA
AATATAGCGCGCAAACTAGGATAAATTATCGCGCGCGGTGTCATCTATGTTACTAGATCGA*ACCCAG
CTTTCTTGTACAAAGTGGTCCCC

FIG. 74 (cont)

LpOs06g0607800 - 26S prot

GGGGACAAGT TTGTACAAAA AAGCAGGCTG *TGCAGCGTGA CCCGGTCGTG CCCCTCTCTA*
*GAGATAATGA GCATTGCATG TCTAAGTTAT AAAAAATTAC CACATATTTT TTTTGTCACA*
*CTTGTTTGAA GTGCAGTTTA TCTATCTTTA TACATATATT TAAACTTTAC TCTACGAATA*
*ATATAATCTA TAGTACTACA ATAATATCAG TGTTTTAGAG AATCATATAA ATGAACAGTT*
*AGACATGGTC TAAAGGACAA TTGAGTATTT TGACAACAGG ACTCTACAGT TTTATCTTTT*
*TAGTGTGCAT GTGTTCTCCT TTTTTTTGC AAATAGCTTC ACCTATATAA TACTTCATCC*
*ATTTATTAG TACATCCATT TAGGGTTTAG GGTTAATGGT TTTTATAGAC TAATTTTTTT*
*AGTACATCTA TTTTATTCTA TTTTAGCCTC TAAATTAAGA AAACTAAAAC TCTATTTTAG*
*TTTTTTTATT TAATAATTTA GATATAAAAT AGAATAAAAT AAAGTGACTA AAAATTAAAC*
*AAATACCCTT TAAGAAATTA AAAAAACTAA GGAAACATTT TTCTTGTTTC GAGTAGATAA*
*TGCCAGCCTG TTAAACGCCG TCGACGAGTC TAACGGACAC CAACCAGCGA ACCAGCAGCG*
*TCGCGTCGGG CCAAGCGAAG CAGACGGCAC GGCATCTCTG*
*TCGCTGCCTC TGGACCCCTC TCGAGAGTTC CGCTCCACCG TTGGACTTGC TCCGCTGTCG*
*GCATCCAGAA ATTGCGTGGC GGAGCGGCAG ACGTGAGCCG GCACGGCAGG CGGCCTCCTC*
*CTCCTCTCAC GGCACGGCAG CTACGGGGA TTCCTTTCCC ACCGCTCCTT CGCTTTCCCT*
*TCCTCGCCCG CCGTAATAAA TAGACACCCC CTCCACACCC TCTTTCCCCA ACCTCGTGTT*
*GTTCGGAGCG CACACACACA CAACCAGATC TCCCCCAAAT CCACCCGTCG GCACCTCCGC*
<u>*TTCAAG*</u>GTAC GCCGCTCGTC CTCCCCCCCC CCCCCTCTCT ACCTTCTCTA GATCGGCGTT
CCGGTCCATG GTTAGGGCCC GGTAGTTCTA CTTCTGTTCA TGTTTGTGTT AGATCCGTGT
TTGTGTTAGA TCCGTGCTGC TAGCGTTCGT ACACGGATGC GACCTGTACG TCAGACACGT
TCTGATTGCT AACTTCCAG TGTTTCTCTT TGGGGAATCC TGGGATGGCT CTAGCCGTTC
CGCAGACGGG ATCGATTTCA TGATTTTTTT TGTTTCGTTG CATAGGGTTT GGTTTGCCCT
TTTCCTTTAT TTCAATATAT GCCGTGCACT TGTTTGTCGG GTCATCTTTT CATGCTTTTT
TTTGTCTTGG TTGTGATGAT GTGGTCTGGT TGGGCGGTCG
TTCTAGATCG GAGTAGAATT CTGTTTCAAA CTACCTGGTG GATTTATTAA TTTTGGATCT
GTATGTGTGT GCCATACATA TTCATAGTTA CGAATTGAAG ATGATGGATG GAAATATCGA
TCTAGGATAG GTATACATGT TGATGCGGGT TTTACTGATG CATATACAGA GATGCTTTTT
GTTCGCTTGG TTGTGATGAT GTGGTGTGGT TGGGCGGTCG TTCATTCGTT CTAGATCGGA
GTAGAATACT GTTTCAAACT ACCTGGTGTA TTTATTAATT TTGAACTGT ATGTGTGTGT
CATACATCTT CATAGTTACG AGTTTAAGAT GGATGGAAAT ATCGATCTAG GATAGGTATA
CATGTTGATG TGGGTTTTAC TGATGCATAT ACATGATGGC ATATGCAGCA TCTATTCATA
TGCTCTAACC TTGAGTACCT ATCTATTATA ATAAACAAGT ATGTTTTATA ATTATTTTGA
TCTTGATATA CTTGGATGAT GGCATATGCA GCAGCTATAT GTGGATTTTT TTAGCCCTGC
CTTCATACGC TATTTATTTG CTTGGTACTG TTTCTTTTGT CGATGCTCAC CCTGTTGTTT
GGTGTTACTT CTGCAGG<u>CCA ATGGCATCGA TTTCATCCAT GAAAATAATA CATGGTTGAT</u>
<u>GCTCACGTGC ATAGTTGAAC ATTTCTCTTA TAAGACGGGC</u>
<u>ACTTTCACCA ATATATTTGT CAATGATAGC ACTTGAAACA ATCTTTAAAA AGTTTGCATC</u>
<u>GATGTTGCTA GCAATAGCTC TAGCAAGCAA TGTCTTCCCC GTTCCAGGTG GGCCATAGAG</u>
<u>CAGAACACCC TTTGGCGGTT TGATTCCAAC ACGGAGAAAC AGTTCAGGAT TCATAAGCGG</u>
<u>TAACTCGATG GACTCCCGCA GTTCCCTTAT TTGATCTGAT AATCCACCTA CAGCTGAGTA</u>
<u>ACTGACGTTG CCTGGGTCTT CATGTAGCAT GTTATAGACC ACCGGATCAA CCTCACGCGG</u>

FIG. 75

```
TAGAGTTCTC ATAATGGTTA AAGTTGTCAT GTCAAGAACA ACCCGCGTTC CAGCTGTCAG
CTTTTCTTTG TCAACTTTAC TCCTGCAGCC AACCACATAA CGTGGCCCAC TACTGGCAAA
GGTATGGATA GTGTATCTTC ATACTGCATT TGTTTAATTT GAAAATGGTT ATCTAGTTGC
CTAACAAAAT ATAGCTGGGA TATCTTATAA CACATGTGCA GGTGACATGG AAAAAAATGC
CTATTTTTCT ATGCACTAAC TATTCATCAT GTGACATACT TCCCCAAAAA ACTAAATAAG
CCAAATTTTC CAGCTTCCGA GTCCTGAAAA AGAGTAGTGT ACCTGATACA ATTTATAGAG
TTTTTTTTTT CGAAAAGAAG GGATAGCCCT CATAGATAGA GTACTAACTA AAAGTCTACT
TTTACCAATT TCAGGTTTTT GGCCAGTAGT GGGCCACGTT ATGTGGTTGG CTGCAGGAGT
AAAGTTGACA AAGAAAAGCT GACAGCTGGA ACGCGGGTTG TTCTTGACAT GACAACTTTA
ACCATTATGA GAACTCTACC GCGTGAGGTT GATCCGGTGG TCTATAACAT GCTACATGAA
GACCCAGGCA ACGTCAGTTA CTCAGCTGTA GGTGGATTAT CAGATCAAAT AAGGGAACTG
CGGGAGTCCA TCGAGTTACC GCTTATGAAT CCTGAACTGT TTCTCCGTGT TGGAATCAAA
CCGCCAAAGG GTGTTCTGCT CTATGGCCCA CCTGGAACGG GGAAGACATT GCTTGCTAGA
GCTATTGCTA GCAACATCGA TGCAAACTTT TTAAAGATTG TTTCAAGTGC TATCATTGAC
AAATATATTG GTGAAAGTGC CCGTCTTATA AGAGAAATGT TCAACTATGC ACGTGAGCAT
CAACCATGTA TTATTTTCAT GGATGAAATC GATGCCATTG GAGAAGGAGT GCGTCGAAGC
*AGATCGTTCA AACATTTGGC AATAAAGTTT CTTAAGATTG AATCCTGTTG CCGGTCTTGC*
*GATGATTATC ATATAATTTC TGTTGAATTA CGTTAAGCAT GTAATAATTA ACATGTAATG*
*CATGACGTTA TTTATGAGAT*
*GGGTTTTTAT GATTAGAGTC CCGCAATTAT ACATTTAATA CGCGATAGAA AACAAAATAT*
*AGCGCGCAAA CTAGGATAAA TTATCGCGCG CGGTGTCATC TATGTTACTA GATCGAA*CCC
AGCTTTCTTG TACAAAGTGG TCCCC
```

FIG. 75 (cont)

LpOs06g0607900 - NOP Gram domain

```
GGGGACAAGT TTGTACAAAA AAGCAGGCTG TGCAGCGTGA CCCGGTCGTG
CCCCTCTCTA GAGATAATGA GCATTGCATG TCTAAGTTAT AAAAAATTAC
CACATATTTT TTTTGTCACA CTTGTTTGAA GTGCAGTTTA TCTATCTTTA
TACATATATT TAAACTTTAC TCTACGAATA ATATAATCTA TAGTACTACA
ATAATATCAG TGTTTTAGAG AATCATATAA ATGAACAGTT AGACATGGTC
TAAAGGACAA TTGAGTATTT TGACAACAGG ACTCTACAGT TTTATCTTTT
TAGTGTGCAT GTGTTCTCCT TTTTTTTTGC AAATAGCTTC ACCTATATAA
TACTTCATCC ATTTATTAG TACATCCATT TAGGGTTTAG GGTTAATGGT
TTTTATAGAC TAATTTTTTT AGTACATCTA TTTTATTCTA TTTTAGCCTC
TAAATTAAGA AAACTAAAAC TCTATTTTAG TTTTTTTATT TAATAATTTA
GATATAAAAT AGAATAAAAT AAAGTGACTA AAAATTAAAC AAATACCCTT
TAAGAAATTA AAAAAACTAA GGAAACATTT TTCTTGTTTC GAGTAGATAA
TCCCAGCCTG TTAAACGCCG TCGACGACTC TAACGGACAC CAACCAGCCA
ACCAGCAGCG TCGCGTCGGG CCAAGCGAAG CAGACGGCAC GGCATCTCTG
TCGCTGCCTC TGGACCCCTC TCGAGAGTTC CGCTCCACCG TTGGACTTGC
TCCGCTGTCG GCATCCAGAA ATTGCGTGGC GGAGCGGCAG ACGTGAGCCG
GCACGGCAGG CGGCCTCCTC CTCCTCTCAC GGCACGGCAG CTACGGGGGA
TTCCTTTCCC ACCGCTCCTT CGCTTTCCCT TCCTCGCCCG CCGTAATAAA
TAGACACCCC CTCCACACCC TCTTTCCCCA ACCTCGTGTT GTTCGGAGCG
CACACACACA CAACCAGATC TCCCCCAAAT CCACCCGTCG GCACCTCCGC
TTCAAGGTAC GCCGCTCGTC CTCCCCCCCC CCCCCTCTCT ACCTTCTCTA
GATCGGCGTT CCGGTCCATG GTTAGGGCCC GGTAGTTCTA CTTCTGTTCA
TGTTTGTGTT AGATCCGTGT TTGTGTTAGA TCCGTGCTGC TAGCGTTCGT
ACACGGATGC GACCTGTACG TCAGACACGT TCTGATTGCT AACTTGCCAG
TGTTTCTCTT TGGGGAATCC TGGGATGGCT CTAGCCGTTC CGCAGACGGG
ATCGATTTCA TGATTTTTTT TGTTTCGTTG CATAGGGTTT GGTTTGCCCT
TTTCCTTTAT TTCAATATAT GCCGTGCACT TGTTTGTCGG GTCATCTTTT
CATGCTTTTT TTTGTCTTGG TTGTGATGAT GTGGTCTGGT TGGGCGGTCG
TTCTAGATCG GAGTAGAATT CTGTTTCAAA CTACCTGGTG GATTTATTAA
TTTTGGATCT GTATGTGTGT GCCATACATA TTCATAGTTA CGAATTGAAG
ATGATGGATG GAAATATCGA TCTAGGATAG GTATACATGT TGATGCGGGT
TTTACTGATG CATATACAGA GATGCTTTTT GTTCGCTTGG TTGTGATGAT
GTGGTGTGGT TGGGCGGTCG TTCATTCGTT CTAGATCGGA GTAGAATACT
GTTTCAAACT ACCTGGTGTA TTTATTAATT TTGGAACTGT ATGTGTGTGT
CATACATCTT CATAGTTACG AGTTTAAGAT GGATGGAAAT ATCGATCTAG
GATAGGTATA CATGTTGATG TGGGTTTTAC TGATGCATAT ACATGATGGC
ATATGCAGCA TCTATTCATA TGCTCTAACC TTGAGTACCT ATCTATTATA
ATAAACAAGT ATGTTTTATA ATTATTTTGA TCTTGATATA CTTGGATGAT
GGCATATGCA GCAGCTATAT GTGGATTTTT TTAGCCCTGC CTTCATACGC
TATTTATTTG CTTGGTACTG TTTCTTTTGT CGATGCTCAC CCTGTTGTTT
```

FIG. 76

```
GGTGTTACTT CTGCAGGGCC AACTGGCCCA CAACCTCAGG CCCAGCATAC
ACACAGCGAC GTAGGCCTCC AAGGCGGACT GAGGGCAAGA TGCACGGCTC
ACTGTGACAG ACACCAGCCT AGACGAGAAG AACAGCCAAG GCGTCCTCGC
GGCAGGCCCA AGCACGCAAC TCCCGAACTC GAATTGGTCA AAACCGAAAA
CCCTAGCCTG CAACCCTCCT AAATAATCAC GGAAAACCAG ATCTTCTCGT
CCAGTAGCCA GCAACCCTAG CCAGGACCCG CGGATAGCTC GGAGCGAGTC
AACTAGCCTG AACCCTGTGC GGACCCTCGT CTCCAGCTCG CGGCAGTTGA
GGAGCTTGTT GCGGTAGTCG GTGACCACGG TGCGGCGGCG GGCGGCCGCG
GCATCGTCGG CCTCGGCAAA GGTATGGATA GTGTATCTTC ATACTGCATT
TGTTTAATTT GAAAATGGTT ATCTAGTTGC CTAACAAAAT ATAGCTGGGA
TATCTTATAA CACATGTGCA GGTGACATGG AAAAAAATGC CTATTTTTCT
ATGCACTAAC TATTCATCAT GTGACATACT TCCCCAAAAA ACTAAATAAG
CCAAATTTTC CAGCTTCCGA GTCCTGAAAA AGAGTAGTGT ACCTGATACA
ATTTATAGAG TTTTTTTTTT CGAAAAGAAG GGATAGCCCT CATAGATAGA
GTACTAACTA AAAGTCTACT TTTACCAATT TCAGGTTTTT GGCCGAGGCC
GACGATGCCG CGGCCGCCCG CCGCCGCACC GTGGTCACCG ACTACCGCAA
CAAGCTCCTC AACTGCCGCG AGCTGGAGAC GAGGGTCCGC ACAGGGTTCA
GGCTAGTTGA CTCGCTCCGA GCTATCCGCG GGTCCTGGCT AGGGTTGCTG
GCTACTGGAC GAGAAGATCT GGTTTTCCGT GATTATTTAG GAGGGTTGCA
GGCTAGGGTT TTCGGTTTTG ACCAATTCGA GTTCGGGAGT TGCGTGCTTG
GGCCTGCCGC GAGGACGCCT TGGCTGTTCT TCTCGTCTAG GCTGGTGTCT
GTCACAGTGA GCCGTGCATC TTGCCCTCAG TCCGCCTTGG AGGCCTACGT
CGCTGTGTGT ATGCTGGGCC TGAGGTTGTG GGCCAGTTGG CAGAAGGAGT
GCGTCGAAGC AGATCGTTCA AACATTTGGC AATAAAGTTT CTTAAGATTG
AATCCTGTTG CCGGTCTTGC GATGATTATC ATATAATTTC TGTTGAATTA
CGTTAAGCAT GTAATAATTA ACATGTAATG CATGACGTTA TTTATGAGAT
GGGTTTTTAT GATTAGAGTC CCGCAATTAT ACATTTAATA CGCGATAGAA
AACAAAATAT AGCGCGCAAA CTAGGATAAA TTATCGCGCG CGGTGTCATC
TATGTTACTA GATCGAACCC AGCTTTCTTG TACAAAGTGG TCCCC
```

FIG. 76 (cont)

LpOs04g0648500 – ubi

GGGGACAAGT TTGTACAAAA AAGCAGGCTG *TGCAGCGTGA CCCGGTCGTG CCCCTCTCTA*
*GAGATAATGA GCATTGCATG TCTAAGTTAT AAAAAATTAC CACATATTTT TTTTGTCACA*
*CTTGTTTGAA GTGCAGTTTA TCTATCTTTA TACATATATT TAAACTTTAC TCTACGAATA*
*ATATAATCTA TAGTACTACA ATAATATCAG TGTTTTAGAG AATCATATAA ATGAACAGTT*
*AGACATGGTC TAAAGGACAA TTGAGTATTT TGACAACAGG ACTCTACAGT TTTATCTTTT*
*TAGTGTGCAT GTGTTCTCCT TTTTTTTTGC AAATAGCTTC ACCTATATAA TACTTCATCC*
*ATTTTATTAG TACATCCATT TAGGGTTTAG GGTTAATGGT TTTTATAGAC TAATTTTTTT*
*AGTACATCTA TTTTATTCTA TTTTAGCCTC TAAATTAAGA AAACTAAAAC TCTATTTTAG*
*TTTTTTTATT TAATAATTTA GATATAAAAT AGAATAAAAT AAAGTGACTA AAAATTAAAC*
*AAATACCCTT TAAGAAATTA AAAAAACTAA GGAAACATTT TTCTTGTTTC GAGTAGATAA*
*TGCCAGCCTG TTAAACGCCG TCGACGAGTC TAACGGACAC CAACCAGCGA ACCAGCAGCG*
*TCGCGTCGGG CCAAGCGAAG CAGACGGCAC GGCATCTCTG TCGCTGCCTC TGGACCCCTC*
*TCGAGAGTTC CGCTCCACCC TTGGACTTGC TCCGCTGTCG CCATCCAGAA ATTGCGTGGC*
*GGAGCGGCAG ACGTGAGCCG GCACGGCAGG CGGCCTCCTC CTCCTCTCAC GGCACGGCAG*
*CTACGGGGGA TTCCTTTCCC ACCGCTCCTT CGCTTTCCCT TCCTCGCCCG CCGTAATAAA*
*TAGACACCCC CTCCACACCC TCTTTCCCCA ACCTCGTGTT GTTCGGAGCG CACACACACA*
*CAACCAGATC TCCCCCAAAT CCACCCGTCG GCACCTCCGC TTCAAG*GTAC GCCGCTCGTC
CTCCCCCCCC CCCCCTCTCT ACCTTCTCTA GATCGGCGTT CCGGTCCATG GTTAGGGCCC
GGTAGTTCTA CTTCTGTTCA TGTTTGTGTT AGATCCGTGT TTGTGTTAGA TCCGTGCTGC
TAGCGTTCGT ACACGGATGC GACCTGTACG TCAGACACGT TCTGATTGCT AACTTGCCAG
TGTTTCTCTT TGGGGAATCC TGGGATGGCT CTAGCCGTTC CGCAGACGGG ATCGATTTCA
TGATTTTTTT TGTTTCGTTG CATAGGGTTT GGTTTGCCCT TTTCCTTTAT TTCAATATAT
GCCGTGCACT TGTTTGTCGG GTCATCTTTT CATGCTTTTT TTTGTCTTGG TTGTGATGAT
GTGGTCTGGT TGGGCGGTCG TTCTAGATCG GAGTAGAATT CTGTTTCAAA CTACCTGGTG
GATTTATTAA TTTTGGATCT GTATGTGTGT GCCATACATA TTCATAGTTA CGAATTGAAG
ATGATGGATG GAAATATCGA TCTAGGATAG GTATACATGT TGATGCGGGT TTTACTGATG
CATATACAGA GATGCTTTTT GTTCGCTTGG TTGTGATGAT GTGGTGTGGT TGGGCGGTCG
TTCATTCGTT CTAGATCGGA GTAGAATACT GTTTCAAACT ACCTGGTGTA TTTATTAATT
TTGGAACTGT ATGTGTGTGT CATACATCTT CATAGTTACG AGTTTAAGAT GGATGGAAAT
ATCGATCTAG GATAGGTATA CATGTTGATG TGGGTTTTAC TGATGCATAT ACATGATGGC
ATATGCAGCA TCTATTCATA TGCTCTAACC TTGAGTACCT ATCTATTATA ATAAACAAGT
ATGTTTTATA ATTATTTTGA TCTTGATATA CTTGGATGAT GGCATATGCA GCAGCTATAT
GTGGATTTTT TTAGCCCTGC CTTCATACGC TATTTATTTG CTTGGTACTG TTTCTTTTGT
CGATGCTCAC CCTGTTGTTT GGTGTTACTT CTGCAGG*CCT TTCCTCTATT CCTTTTACTG*
*TCTTGGACCA TATATCCTGG CTCTTCATGA GTTTTCATT CATTTCTGCA ACTTTCTTTT*

*TCTCCAACAT AGTATTTTCA AGCTTAAGTT GCATCTCTTG AAGCTTATCA TTTACAGCTT*
*TATCCACAGC AACAGAAATG TGTTCCCTAT CTTTCTTAGC GTCTGACAGA AAGCCTCGTA*
*ATACTCTCTC TGAGTTTCAA GTTGGCTTGC AAGAAGACGG TTGTACTCAT CCACGATTGT*
*ATCAGTTTTG CTGCTAAACA TAACTCCACC CATATCCGAG TCATCGTTGT CCCCAGAAAA*
*TTCACACTTT GACCTGAGCT TAGAATGTTT TGCATCGCTT TTCGAGTGAT TAAGACGATG*
*AACATAACTG TCACCGACAT AATCCCAAAC ACGTTGAGTT TCCAAATCAA GAGAATAGCA*
*GTGCTGAGTG TCTTTCCAGT GCCTAATTGA GTGGCCTTCT TTATACCTTC CGCATCCAAC*
*AAAACCACAT ATCACACAGA TCCAGAGGTT TTCAGAGGTC TGACAAACAG AACATGTAGG*
*ATTTGTAGGA GTTTC*AAAGG TATGGATAGT GTATCTTCAT ACTGCATTTG TTTAATTTGA
AAATGGTTAT CTAGTTGCCT AACAAAATAT AGCTGGGATA TCTTATAACA CATGTGCAGG
TGACATGGAA AAAAATGCCT ATTTTCTAT GCACTAACTA TTCATCATGT GACATACTTC

FIG. 77

CCCAAAAAAC TAAATAAGCC AAATTTTCCA GCTTCCGAGT CCTGAAAAAG AGTAGTGTAC
CTGATACAAT TTATAGAGTT TTTTTTTTCG AAAAGAAGGG ATAGCCCTCA TAGATAGAGT
ACTAACTAAA AGTCTACTTT TACCAATTTC AGGTTTTTGG AAACTCCTAC AAATCCTACA
TGTTCTGTTT GTCAGACCTC TGAAAACCTC TGGATCTGTG TGATATGTGG TTTTGTTGGA
TGCGGAAGGT ATAAAGAAGG CCACTCAATT AGGCACTGGA AAGACACTCA GCACTGCTAT
TCTCTTGATT TGGAAACTCA ACGTGTTTGG GATTATGTCG GTGACAGTTA TGTTCATCGT
CTTAATCACT CGAAAAGCGA TGCAAACAT TCTAAGCTCA GGTCAAAGTG TGAATTTTCT
GGGGACAACG ATGACTCGGA TATGGGTGGA GTTATGTTTA GCAGCAAAAC TGATACAATC
GTGGATGAGT ACAACCGTCT TCTTGCAAGC CAACTTGAAA CTCAGAGAGA GTATTACGAG
GCTTTCTGTC AGACGCTAAG AAAGATAGGG AACACATTTC TGTTGCTGTG GATAAAGCTG
TAAATGATAA GCTTCAAGAG ATGCAACTTA AGCTTGAAAA TACTATGTTG GAGAAAAAGA
AAGTTGCAGA AATGAATGAA AAACTCATGA AGAGCCAGGA TATATGGTCC AAGACAGTAA
AAGGAATAGA *GGAAAGG**AGA AGGAGTGCGT CGAAGCAGAT CGTTCAAACA TTTGGCAATA
AAGTTTCTTA AGATTGAATC CTGTTGCCGG TCTTGCGATG ATTATCATAT AATTTCTGTT
GAATTACGTT AAGCATGTAA TAATTAACAT GTAATGCATG ACGTTATTTA TGAGATGGGT
TTTTATGATT AGAGTCCCGC AATTATACAT TTAATACGCG ATAGAAACA AAATATAGCG
CGCAAACTAG GATAAATTAT CGCGCGCGGT GTCATCTATG TTACTAGATC G*AACCCAGCT
TTCTTGTACA AAGTGGTCCCC

FIG. 77 (cont)

LpOs04g0648600

GGGGACAAGTTTGTACAAAAAAGCAGGCT_GTGCAGCGTGACCCGGTCGTGCCCCTCTCTAGAGATAA_
_TGAGCATTGCATGTCTAAGTTATAAAAAATTACCACATATTTTTTTGTCACACTTGTTTGAAGTGC_
_AGTTTATCTATCTTTATACATATATTTAAACTTTACTCTACGAATAATATAATCTATAGTACTACAA_
_TAATATCAGTGTTTTAGAGAATCATATAAATGAACAGTTAGACATGGTCTAAAGGACAATTGAGTAT_
_TTTGACAACAGGACTCTACAGTTTTATCTTTTTAGTGTGCATGTGTTCTCCTTTTTTTTGCAAATA_
_GCTTCACCTATATAATACTTCATCCATTTATTAGTACATCCATTTAGGGTTTAGGGTTAATGGTTT_
_TTATAGACTAATTTTTTAGTACATCTATTTTATTCTATTTTAGCCTCTAAATTAAGAAAACTAAAA_
_CTCTATTTTAGTTTTTTTATTTAATAATTTAGATATAAAATAGAATAAAATAAAGTGACTAAAAATT_
_AAACAAATACCCTTTAAGAAATTAAAAAAACTAAGGAAACATTTTTCTTGTTTCGAGTAGATAATGC_
_CAGCCTGTTAAACGCCGTCGACGAGTCTAACGGACACCAACCAGCGAACCAGCAGCGTCGCGTCGGG_
_CCAAGCGAAGCAGACGGCACGGCATCTCTGTCGCTGCCTCTGGACCCCTCTCGAGAGTTCCGCTCCA_
_CCGTTGGACTTGCTCCGCTGTCGGCATCCAGAAATTGCGTGGCGGAGCGGCAGACGTGAGCCGGCAC_
_GGCAGGCGGCCTCCTCCTCCTCTCACGGCACGGCAGCTACGGGGATTCCTTTCCCACCGCTCCTTC_
_GCTTTCCCTTCCTCGCCCGCCGTAATAAATAGACACCCCCTCCACACCCTCTTTCCCCAACCTCGTG_
_TTGTTCGGAGCGCACACACACACAACCAGATCTCCCCAAATCCACCCGTCGGCACCTCCGCTTCAA_
_G_GTACGCCGCTCGTCCTCCCCCCCCCCCCTCTCTACCTTCTCTAGATCGGCGTTCCGGTCCATGGT
TAGGGCCCGGTAGTTCTACTTCTGTTCATGTTTGTGTTAGATCCGTGTTTGTGTTAGATCCGTGCTG
CTAGCGTTCGTACACGGATGCGACCTGTACGTCAGACACGTTCTGATTGCTAACTTGCCAGTGTTTC
TCTTTGGGGAATCCTGGGATGGCTCTAGCCGTTCCGCAGACGGGATCGATTTCATGATTTTTTTTGT
TTCGTTGCATAGGGTTTGGTTTGCCCTTTTCCTTTATTTCAATATATGCCGTGCACTTGTTTGTCGG
GTCATCTTTTCATGCTTTTTTTTGTCTTGGTTGTGATGATGTGGTCTGGTTGGGCGGTCGTTCTAGA
TCGGAGTAGAATTCTGTTTCAAACTACCTGGTGGATTTATTAATTTTGGATCTGTATGTGTGTGCCA
TACATATTCATAGTTACGAATTGAAGATGATGGATGGAAATATCGATCTAGGATAGGTATACATGTT
GATGCGGGTTTTACTGATGCATATACAGAGATGCTTTTTGTTCGCTTGGTTGTGATGATGTGGTGTG
GTTGGGCGGTCGTTCATTCGTTCTAGATCGGAGTAGAATACTGTTTCAAACTACCTGGTGTATTTAT
TAATTTTGGAACTGTATGTGTGTGTCATACATCTTCATAGTTACGAGTTTAAGATGGATGGAAATAT
CGATCTAGGATAGGTATACATGTTGATGTGGGTTTTACTGATGCATATACATGATGGCATATGCAGC
ATCTATTCATATGCTCTAACCTTGAGTACCTATCTATTATAATAAACAAGTATGTTTTATAATTATT
TTGATCTTGATATACTTGGATGATGGCATATGCAGCAGCTATATGTGGATTTTTTTAGCCCTGCCTT
CATACGCTATTTATTTGCTTGGTACTGTTTCTTTTGTCGATGCTCACCCTGTTGTTTGGTGTTACTT
CTGCAGGICAGCCTGGCCGTCTTCCTCACCATCGTCGTCCTCCTCCTGGCCGACCTCTTCTGCTCCC
ACCTCCGCCTCCGCCGCCTCCGCGCTGACGCCGAGATGGCGCCGCACAAGAGGCCGAAGCTTGGCGT
CCCGGCGTCGTCCCCGCCGCACACCGCCGACGACGCGTCGGTGGCCACCACCACCACCACGGCGACG
CACGAGGCGCTCTCCAGCACCCCGCCCTTCTACTACGCGCACGGCGTCATGTGCGCGCCCACCCGCA
AGGACCTCCTCCTCGCCATCCCCAAGCTGGAGGCCGCCGTGTGGAAGTGGTCTCCCGCGCGCCGCTC
CTCGCCGTCGCCTTCGCCGCCGCGGTCCGAGCCCACCGCCCGCGAGTCCTCCTCCTCCGCGTACAGC
GACGGCTTCCTGCGCATCTCCAACCCCGTGTACGAGCGGGGCGCCACGGCCGCGCCGGGCGGGTACG
AAGAAGACACGCCGTTCGACACGCCTGACGCATCGCCGAAAGGTATGGATAGTGTATCTTCATACTG
CATTTGTTTAATTTGAAAATGGTTATCTAGTTGCCTAACAAAATATAGCTGGGATATCTTATAACAC
ATGTGCAGGTGACATGGAAAAAAATGCCTATTTTCTATGCACTAACTATTCATCATGTGACATACT
TCCCCAAAAAACTAAATAAGCCAAATTTTCCAGCTTCCGAGTCCTGAAAAAGAGTAGTGTACCTGAT

FIG. 78

ACAATTTATAGAGTTTTTTTTTTCGAAAAGAAGGGATAGCCCTCATAGATAGAGTACTAACTAAAAG
TCTACTTTTACCAATTTCAGGTTTTTGCGGCGATGCGTCAGGCGTGTCGAACGGCGTGTCTTCTTCG
TACCCGCCCGGCGCGGCCGTGGCGCCCCGCTCGTACACGGGGTTGGAGATGCGCAGGAAGCCGTCGC
TGTACGCGGAGGAGGAGGACTCGCGGGCGGTGGGCTCGGACCGCGGCGGCGAAGGCGACGGCGAGGA
GCGGCGCGCGGGAGACCACTTCCACACGGCGGCCTCCAGCTTGGGGATGGCGAGGAGGAGGTCCTTG
CGGGTGGGCGCGCACATGACGCCGTGCGCGTAGTAGAAGGGCGGGGTGCTGGAGAGCGCCTCGTGCG
TCGCCGTGGTGGTGGTGGTGGCCACCGACGCGTCGTCGGCGGTGTGCGGCGGGGACGACGCCGGGAC
GCCAAGCTTCGGCCTCTTGTGCGGCGCCATCTCGGCGTCAGCGCGGAGGCGGCGGAGGCGGAGGTGG
GAGCAGAAGAGGTCGGCCAGGAGGAGGACGACGATGGTGAGGAAGACGGCCAGGCTGA*AGAAGGAGT*
*GCGTCGAAGCAGATCGTTCAAACATTTGGCAATAAAGTTTCTTAAGATTGAATCCTGTTGCCGGTCT*
*TGCGATGATTATCATATAATTTCTGTTGAATTACGTTAAGCATGTAATAATTAACATGTAATGCATG*
*ACGTTATTTATGAGATGGGTTTTTATGATTAGAGTCCCGCAATTATACATTTAATACGCGATAGAAA*
*ACAAAATATAGCGCGCAAACTAGGATAAATTATCGCGCGGTGTCATCTATGTTACTAGATCGA*<u>AC</u>
<u>CCAGCTTTCTTGTACAAAGTGGT</u>CCCC

FIG. 78 (cont)

LpOs04g0648900

GGGGACAAGTTTGTACAAAAAAGCAGGCT_GTGCAGCGTGACCCGGTCGTGCCCCTCTCTAGAGATAA_
_TGAGCATTGCATGTCTAAGTTATAAAAAATTACCACATATTTTTTTGTCACACTTGTTTGAAGTGC_
_AGTTTATCTATCTTTATACATATATTTAAACTTTACTCTACGAATAATATAATCTATAGTACTACAA_
_TAATATCAGTGTTTTAGAGAATCATATAAATGAACAGTTAGACATGGTCTAAAGGACAATTGAGTAT_
_TTTGACAACAGGACTCTACAGTTTTATCTTTTTAGTGTGCATGTGTTCTCCTTTTTTTTGCAAATA_
_GCTTCACCTATATAATACTTCATCCATTTTATTAGTACATCCATTTAGGGTTTAGGGTTAATGGTTT_
_TTATAGACTAATTTTTTTAGTACATCTATTTTATTCTATTTTAGCCTCTAAATTAAGAAAACTAAAA_
_CTCTATTTTAGTTTTTTTATTTAATAATTTAGATATAAAATAGAATAAAATAAAGTGACTAAAAATT_
_AAACAAATACCCTTTAAGAAATTAAAAAAACTAAGGAAACATTTTTCTTGTTTCGAGTAGATAATGC_
_CAGCCTGTTAAACGCCGTCGACGAGTCTAACGGACACCAACCAGCGAACCAGCAGCGTCGCGTCGGG_
_CCAAGCGAAGCAGACGGCACGGCATCTCTGTCGCTGCCTCTGGACCCCTCTCGAGAGTTCCGCTCCA_
_CCGTTGGACTTGCTCCGCTGTCGGCATCCAGAAATTGCGTGGCGGAGCGGCAGACGTGAGCGGCAC_
_GGCAGGCGGCCTCCTCCTCCTCTCACGGCACGGCAGCTACGGGGATTCCTTTCCCACCGCTCCTTC_
_GCTTTCCCTTCCTCGCCCGCCGTAATAAATAGACACCCCTCCACACCCTCTTT_CCCCAACCTCGTG
_TTGTTCGGAGCGCACACACACACAACCAGATCTCCCCCAAATCCACCCGTCGGCACCTCCGCTTCAA_
_G_GTACGCCGCTCGTCCTCCCCCCCCCCCCTCTCTACCTTCTCTAGATCGGCGTTCCGGTCCATGGT
TAGGGCCCGGTAGTTCTACTTCTGTTCATGTTTGTGTTAGATCCGTGTTTGTGTTAGATCCGTGCTG
CTAGCGTTCGTACACGGATGCGACCTGTACGTCAGACACGTTCTGATTGCTAACTTGCCAGTGTTTC
TCTTTGGGGAATCCTGGGATGGCTCTAGCCGTTCCGCAGACGGGATCGATTTCATGATTTTTTTGT
TTCGTTGCATAGGGTTTGGTTTGCCCTTTTCCTTTATTTCAATATATGCCGTGCACTTGTTTGTCGG
GTCATCTTTTCATGCTTTTTTTTGTCTTGGTTGTGATGATGTGGTCTGGTTGGGCGGTCGTTCTAGA
TCGGAGTAGAATTCTGTTTCAAACTACCTGGTGGATTTATTAATTTTGGATCTGTATGTGTGTGCCA
TACATATTCATAGTTACGAATTGAAGATGATGGATGGAAATATCGATCTAGGATAGGTATACATGTT
GATGCGGGTTTTACTGATGCATATACAGAGATGCTTTTTGTTCGCTTGGTTGTGATGATGTGGTGTG
GTTGGGCGGTCGTTCATTCGTTCTAGATCGGAGTAGAATACTGTTTCAAACTACCTGGTGTATTTAT
TAATTTTGGAACTGTATGTGTGTGTCATACATCTTCATAGTTACGAGTTTAAGATGGATGGAAATAT
CGATCTAGGATAGGTATACATGTTGATGTGGGTTTTACTGATGCATATACATGATGGCATATGCAGC
ATCTATTCATATGCTCTAACCTTGAGTACCTATCTATTATAATAAACAAGTATGTTTTATAATTATT
TTGATCTTGATATACTTGGATGATGGCATATGCAGCAGCTATATGTGGATTTTTTAGCCCTGCCTT
CATACGCTATTTATTTGCTTGGTACTGTTTCTTTTGTCGATGCTCACCCTGTTGTTTGGTGTTACTT
CTGCAGGATGGCGCCTCTTGCCGCCGCGGCCGCGGCGGTGGCGGCGAAGGAGGAGCTGGGCGTGACG
GTGGCCGTGGCGCCGCCGATGGCGCTGGCCCCGCTGAGCCAGCAGCAGCCGCGGCGGCAGTACCGCG
GCGTGCGCATGCGGAAGTGGGGCAAGTGGGTGGCGGAGATCCGGGAGCCGCACAAGCGCACGCGCAT
CTGGCTCGGCTCCTACGCCACGCCCGTCGCCGCCGCGCGCGCCTACGACACGGCCGTCTTCTACCTG
CGCGGCCGGTCGGCCAGGCTCAACTTCCCCGACGAGATCTCCGCGCTGGCGCCGCTGTCCCGCCGC
CCGAGGAGCTGGAGGCCGACGGCGGCGCGCTGTCGGCGGCGTCGATCGGAAGAAGGCCATCGAGGT
CGGGTCCCGCGTCGACGCGCTCCAGACCGGGATGACCATGGTCGCCACCGCCGCCGCGCCGGCGACA
AACCACCGGGAGCGGCAGAGGCAGCACCACGCCCAGCAGCAGGCTGCGCGCGACGAGGAGCTGCTCC
AGCTCCACCACCAGAAGCAGCAGCGGACGGCGTGGAACGGCGGGCCAAGAACCCGGATCTCAACCA
GGCGCCCGACCCCGACAGCTCCGACGCCGAGTGAAAAGGTATGGATAGTGTATCTTCATACTGCATT

FIG. 79

**TGTTTAATTTGAAAATGGTTATCTAGTTGCCTAACAAAATATAGCTGGGATATCTTATAACACATGT
GCAGGTGACATGGAAAAAAATGCCTATTTTTCTATGCACTAACTATTCATCATGTGACATACTTCCC
CAAAAAACTAAATAAGCCAAATTTTCCAGCTTCCGAGTCCTGAAAAAGAGTAGTGTACCTGATACAA
TTTATAGAGTTTTTTTTTTCGAAAAGAAGGGATAGCCCTCATAGATAGAGTACTAACTAAAAGTCTA
CTTTTACCAATTTCAGGTTTTTG**TCACTCGGCGTCGGAGCTGTCGGGGTCGGGCGCCTGGTTGAGAT
CCGGGTTCTTGGCCCGCCCGTTCCACGCCGTCCGCTGCTGCTTCTGGTGGTGGAGCTGGAGCAGCTC
CTCGTCGCGCGCAGCCTGCTGCTGCGCGTGGTGCTGCCTCTGCCGCTCCCGGTGGTTTGTCGCCGGC
GCGGCGGCGGTGGCGACCATGGTCATCCCGGTCTGGAGCGCGTCGACGCGGGACCCGACCTCGATGG
CCTTCTTCCGGATCGACGCCGCCGACAGCGCGCCGCCGTCGGCCTCCAGCTCCTCGGGCGGCGGGGA
CAGCGGCGCCAGCGCGGAGATCTCGTCGGGGAAGTTGAGCCTGGCCGACCGGCCGCGCAGGTAGAAG
ACGGCCGTGTCGTAGGCGCGCGCGGCGGCGACGGGCGTGGCGTAGGAGCCGAGCCAGATGCGCGTGC
GCTTGTGCGGCTCCCGGATCTCCGCCACCCACTTGCCCCACTTCCGCATGCGCACGCCGCGGTACTG
CCGCCGCGGCTGCTGCTGGCTCAGCGGGGCCAGCGCCATCGGCGGCGCCACGGCCACCGTCACGCCC
AGCTCCTCCTTCGCCGCCACCGCCGCGGCCGCGGCGGCAAGAGGCGCCAT***AGAAGGAGTGCGTCGAA
GCAGATCGTTCAAACATTTGGCAATAAAGTTTCTTAAGATTGAATCCTGTTGCCGGTCTTGCGATGA
TTATCATATAATTTCTGTTGAATTACGTTAAGCATGTAATAATTAACATGTAATGCATGACGTTATT
TATGAGATGGGTTTTTATGATTAGAGTCCCGCAATTATACATTTAATACGCGATAGAAAACAAAATA
TAGCGCGCAAACTAGGATAAATTATCGCGCGCGGTGTCATCTATGTTACTAGATCGA*ACCCAGCTTT
CTTGTACAAAGTGGT**CCCC

FIG. 79 (cont)

A
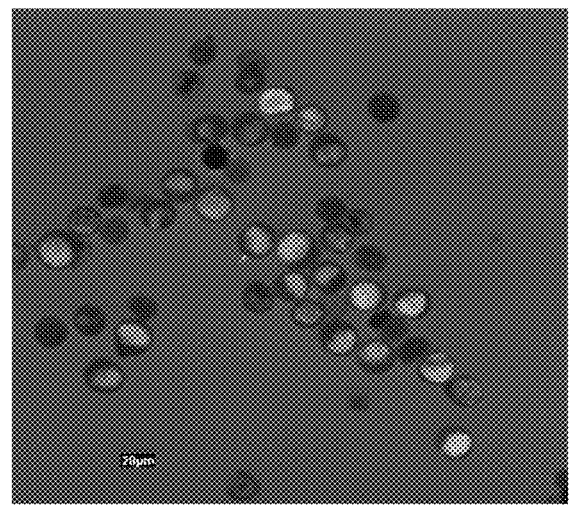
B
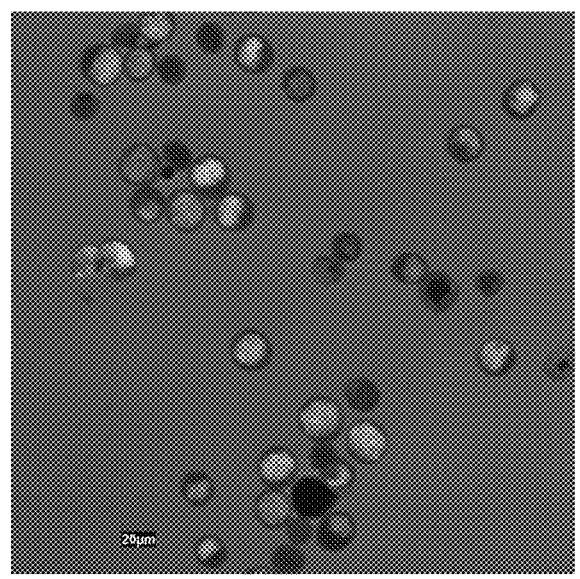
FIG. 82

A
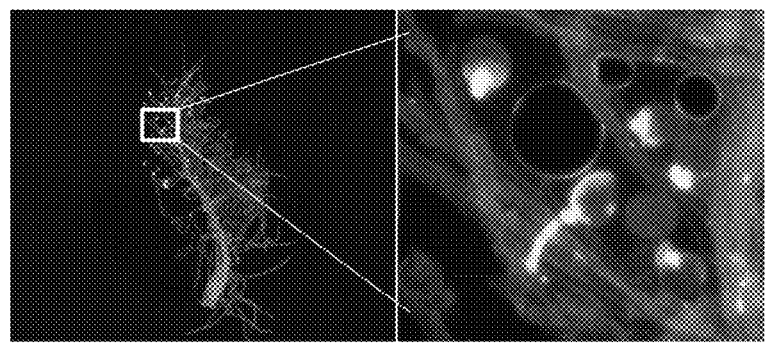
B
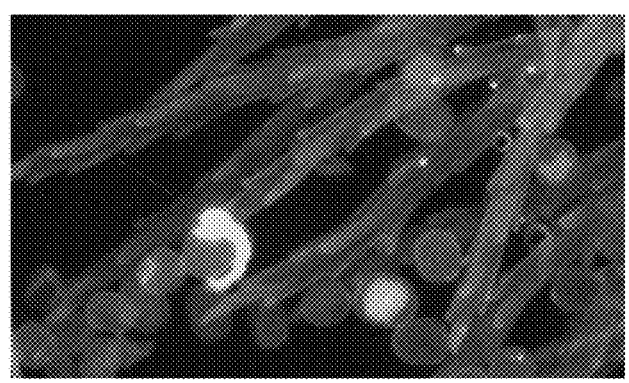
C
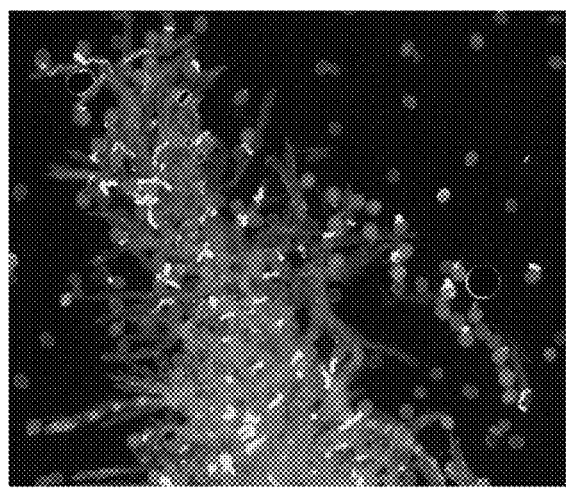
FIG. 84

MANIPULATION OF SELF-INCOMPATIBILITY IN PLANTS

FIELD OF THE INVENTION

The present invention relates to methods for controlling hybridization in plants and methods for producing hybrid plants. The present invention also relates to nucleic acids and nucleic acid fragments encoding amino acid sequences for self-incompatibility proteins in plants, in particular through self-gamete recognition in plants of grass and cereal species, and the use thereof for the manipulation of SI, including seed production, in plants. The present invention also relates to kits, compositions, constructs and vectors including such nucleic acids, and related polypeptides, regulatory elements and methods.

The present invention also relates to expression of self-gamete recognition genes in plants and to related nucleic acids, constructs, molecular markers derived from nucleic acids and related methods.

BACKGROUND OF THE INVENTION

The phenomenon through which some flowering plant species are unable to successfully reproduce through self-pollination has been termed 'self-incompatibility' (SI). A definition of SI was accepted as proposed by Lundqvist, being 'the inability of a fertile hermaphrodite seed-plant to produce zygotes after self-pollination'. This phraseology was in order to distinguish between SI and the effect of post-fertilisation barriers. SI has been described in about 30% of all flowering plants, and is the most important system for prevention of self-fertilization. The key part of this system is self-recognition, in which the pistil discriminates between self- or non-self-pollen to either inhibit or permit pollen tube germination and/or elongation and resulting fertilisation.

There are multiple genetic mechanisms that regulate and enable the system, SI does not represent a unique system. The molecular basis of the plant SI mechanism has been well studied in several groups of dicotyledonous plant species. Self-incompatibility locus (S locus) genes were identified in winged tobacco (*Nicotiana elate*) and *Brassica rapa* L. (syn. *campestris*) in the late 1980s.

Subsequent biological investigations using multiple approaches have identified SI factors, to help elucidate the molecular basis of SI mechanisms in these species.

Plant species within the Poaceae (grass and cereal) family, can display an obligate outbreeding reproductive habit controlled by a two-locus (termed S and Z) gametophytic SI system, in which the pollen genotype is autonomously controlled by its own genetic constitution. This system is conserved between allogamous Poaceae species, such as wild barley (*Hordeum bulbosum* L.) and cereal rye (*Secale cereale* L.) and has been found to be widely conserved within the family, but is expected to be genetically and mechanistically distinct from the well-characterised single-locus SI mechanisms of dicotyledonous plants.

The Poaceae-specific mechanism prevents self-fertilisation through arrest of self-generated gamete pollen tube elongation at the stigmatic surface. Although several of the key molecular signals involved in dicot-specific SI systems have been identified, the molecular basis of the Poaceae system remains unknown.

Free calcium concentrations are essential for directed cell growth in pollen tubes in many species. The role calcium plays was initially identified as increasing cell wall rigidity and regulating permeability. However, the specific concentration of calcium in the cell is critical, as free calcium is typically kept at c. 100 nm due to cellular metabolism being based on free phosphates, and if free cytosolic calcium levels elevate over this concentration, interference with the energy status of the cell will result due to the formation of calcium salts. Studies of calcium gradients within the pollen tube have identified an increased gradient at the active growing tip, and the increase has been postulated to be absorbed by the cellular growth.

Previously, calcium has been identified to play a role in regulation of the SI system in the Poaceae family. Treatment with calcium channel blockers (lanthanum and verapamil) has been demonstrated to inhibit the perennial ryegrass SI mechanism.

By treating excised stigmas with the chemical blocking agents self pollen was able to germinate.

The S and Z loci of perennial ryegrass (*Lolium perenne* L.) have been assigned to linkage groups (LGs) 1 and 2 respectively, in regions of known macrosynteny with the genomes of the inbreeding cereal species rice (*Oryza sativa* L.) and wheat (*Triticum aestivum* L.). Fine-structure mapping of the Poaceae SI loci was performed for blue canary grass (*Phalaris coerulescens* L.) and cereal rye (*Secale cereale* L.), and the candidate gene-containing regions were delimited to 0.26 cM and 1.5 cM intervals for the S and Z loci, respectively. The presence of gene-associated (cDNA-based) markers in these studies permitted comparative analysis to define map colinearity around the SI loci for related self-incompatible and self-compatible Poaceae species. The proposed 1.5 cM Z-containing region exhibited microsynteny with a BAC clone (OSJNBa0070011: GenBank Acc. No. AL606445) from rice chromosome 4 c. 125 kb in length, to which 12 predicted genes have been assigned.

For outbreeding crops, understanding and regulation of SI mechanisms can simplify and accelerate breeding procedures. For example, knowledge of the Solanaceae S-RNase-based SI system informed a method for almond cultivar development through use of a previously-characterised self-compatible ($S_c$) mutant line. The program involved introduction of the $S_c$ allele into existing almond varieties for enhanced fixation of genes for favourable oil content and fatty acid composition. Inbreeding also enables simpler maintenance of agronomically elite lines.

In the standard semi-hybrid breeding scheme for outbreeding pasture crop species, two cultivar groups are intercrossed to generate a progeny population with increased yield owing to heterosis. However, around half the progeny are derived from an intracross within each parental group and do not receive the benefit of heterosis. Heterosis in forage mass has been also reported in perennial ryegrass and other grass crop species using the standard semi-hybrid breeding system.

In a new scheme with SI genotyping technology, an SI-allele restricted population is established, and intercrossing between the restricted population and a cultivar group generates a progeny population with a higher ratio of hybrid progeny. An experiment with red clover proved higher hybrid ratios in progenies and improved seed yields when the restricted populations were used.

Reference to any prior art in the specification is not, and should not be taken as, an acknowledgment or any form of suggestion that this prior art forms part of the common general knowledge in Australia or any other jurisdiction or that this prior art could reasonably be expected to be ascertained, understood and regarded as relevant by a person skilled in the art.

It is an object of the present invention to overcome, or at least alleviate, one or more of the difficulties or deficiencies associated with the prior art.

SUMMARY OF THE INVENTION

Applicants have used an extensive and inclusive approach involving both genomics and transgenic modification for molecular dissection of the SI pathway in monocots. Spatiotemporal profiles of gene expression, comparative genomics, BAC clone sequencing and whole-exome sequencing suggests that the components of the SI pathway (the S and Z genes) may be encoded by a collection of genes from within the Poaceae family that have not been previously characterised as having these functions in ryegrass.

Applicants have found that modification or selection of the genes located at the S and Z loci of outbreeding plants of the Poaceae family is an attractive strategy for controlling pollination and fertilization by repression or activation of the SI mechanism. Applicants have also found that modification or selection of the genes located at the S and Z loci of plants of the Poaceae family may be used to control hybridization or to produce hybrid plants in higher numbers than conventional breeding approaches. By identifying the nucleic acid sequences of the genes, transgenic modification through down-regulation or through inducible expression enables hybrid breeding schemes to be enabled. Modification of the nucleic acids through targeted gene disruption, by the use of transcription activator-like effector nucleases (TALENs) or zinc-finger nucleases (ZFNs), mediating cleavage of specific target sites in the nucleic acid, leading to micro-deletions and insertions within the endogenous nucleic acid sequence, also enables control of fertilisation. The use of molecular markers derived from inherent variation originating from within the nucleic acid sequences may also provide a predictive means for control of fertilisation.

A perennial ryegrass BAC-based genomic library composed of 50,304 (131×384-well plates) BAC clones (average insert size=113 kb) has been constructed to support contig assembly, and estimated to correspond to c. 3.4 genome equivalents (Spangenberg et al. 2005; Forster et al. 2008). A combination of fine-structure genetic linkage mapping and physical genome characterisation enables implementation of map-based cloning to isolate perennial ryegrass SI genes.

In addition, whole-genome sequencing has been performed to generate genic contigs from the perennial ryegrass genome that can assist with gene identification and nucleic acid characterisation. These efforts have been undertaken on a single plant genotype that has been clonally propagated to provide sufficient source material (Cogan et al. 2012a, Forster et al. 2012). A global gene expression (transcriptome) profile has also been extensively generated and characterised through sequencing of RNA nucleic acids from the same plant as was used for the genome sequence (Cogan et al. 2012b, Forster et al. 2012).

Identification and characterisation of the S and Z genes may enable establishment of novel breeding methodology for perennial ryegrass.

For example, plants of the Poaceae family may be transformed with a gametophytic Z gene nucleic acid wherein (1) transformation with said Z gene specific nucleic acid transforms a self incompatible plant of the Poaceae family into a self compatible plant or (2) transformation with said Z gene specific nucleic acid transforms a self compatible plant of the Poaceae family into a self incompatible plant. In a preferred embodiment, the gametophytic Z gene may encode a 26S proteasome subunit, a zinc finger protease, a no-pollen (NOP) polypeptide, or an ubiquitin-specific protease, such as an ubiquitin-specific protease 22.

For example, plants of the Poaceae family may be transformed with a gametophytic S gene nucleic acid wherein (1) transformation with said S gene specific nucleic acid transforms a self incompatible plant of the Poaceae family into a self compatible plant or (2) transformation with said S gene specific nucleic acid transforms a self compatible plant of the Poaceae family into a self incompatible plant. In a preferred embodiment, the gametophytic S gene may encode a Cullin, a glutamate receptor or precursor thereof, or a seven-in-absentia homologue (SIAH).

Accordingly, in a first aspect, the present invention provides a composition or kit for hybridization or self-incompatibility (SI) control in plants, said composition or kit including:
  a first nucleic acid or nucleic acid fragment encoding a SI polypeptide, wherein said first nucleic acid or nucleic acid fragment is isolated from or corresponds to a gene from the Z locus of a plant of the Poaceae family; and
  a second nucleic acid or nucleic acid fragment encoding a SI polypeptide, wherein said second nucleic acid or nucleic acid fragment is isolated from or corresponds to a gene from the S locus of a plant of the Poaceae family.

Preferably said first and second nucleic acids are substantially purified or isolated.

In a preferred embodiment, the first nucleic acid or nucleic acid fragment may be a gametophytic Z gene.

In a preferred embodiment, the second nucleic acid or nucleic acid fragment may be a gametophytic S gene.

In a particularly preferred embodiment the first and second nucleic acids or nucleic acid fragments may be selected from the group of nucleic acids and nucleic acid fragments as hereinafter described.

For example, the Z gene may encode a 26S proteasome subunit, a zinc finger protease, a no-pollen (NOP) polypeptide, or an ubiquitin-specific protease, such as an ubiquitin-specific protease 22, as hereinafter described.

For example, the S gene may encode a Cullin, a glutamate receptor or precursor thereof, or a seven-in-absentia homologue (SIAH), as hereinafter described.

In a further preferred embodiment, the first and second nucleic acids or nucleic acid fragments may be included in a construct or vector, as hereinafter described.

In a further aspect of the present invention there is provided a method for controlling hybridization in a plant or for producing hybrid plants, said method including:
  establishing or identifying a first plant strain with a first Z locus haplotype and a first S locus haplotype;
  establishing or identifying a second plant strain with a second Z locus haplotype and a second S locus haplotype; and
  crossing said plant strains to produce hybrid plants;
  wherein said haplotypes are selected so that the first plant strain is heterozygous at both the S and Z loci and said second plant strain is homozygous at one of the S and Z loci and heterozygous at the other of the S and Z loci.

Preferably the first and second plant strains are plants of the Poaceae family. More preferably they are grass species, particularly pasture grasses such as ryegrass (*Lolium*) or fescue (*Festuca*), more particularly perennial ryegrass (*Lolium perenne* L.) or tall fescue (*Festuca arundinaceum*, otherwise known as *Lolium arundinaceum*).

Preferably the haplotypes are from genes according to the present invention, as hereinafter described.

In a further aspect of the present invention there is provided a method of manipulating self-incompatibility in a plant, said method including introducing into said plant an effective amount of a nucleic acid, construct and/or vector according to the present invention.

In a preferred embodiment the method involves altering the SI status of the plant.

In a preferred embodiment, the method may include introducing into said plant:
a first nucleic acid or nucleic acid fragment encoding a SI polypeptide, wherein said first nucleic acid or nucleic acid fragment is isolated from or corresponds to a gene from the Z locus of a plant of the Poaceae family; and
a second nucleic acid or nucleic acid fragment encoding a SI polypeptide, wherein said second nucleic acid or nucleic acid fragment is isolated from or corresponds to a gene from the S locus of a plant of the Poaceae family.

For example, the Z gene may encode a 26S proteasome subunit, a zinc finger protease, a no-pollen (NOP) polypeptide, or an ubiquitin-specific protease, such as an ubiquitin-specific protease 22, as hereinafter described.

For example, the S gene may encode a Cullin, a glutamate receptor or precursor thereof, or a seven-in-absentia homologue (SIAH), as hereinafter described.

The present invention also contemplates co-expressing a nucleic acid of the present invention with a gene encoding a mediator or modulator of SI activity.

By SI status is meant the ability or inability of a fertile hermaphrodite seed-plant to produce zygotes after self-pollination.

By a 'mediator or modulator of SI activity' is meant a molecule that enhances or otherwise modifies expression, activity or function of SI in a plant cell, plant callus, plant, seed or other plant part. For example, the mediator or modulator of SI activity may improve pollen tube growth, or enhance action or activity of the SI mechanisms.

By "an effective amount" it is meant an amount sufficient to result in an identifiable phenotypic trait in said plant, or a plant, plant seed or other plant part derived therefrom. Such amounts can be readily determined by an appropriately skilled person, taking into account the type of plant, the route of administration and other relevant factors. Such a person will readily be able to determine a suitable amount and method of administration. See, for example, Maniatis et al, Molecular Cloning: A Laboratory Manual, Cold Spring Harbor Laboratory, Cold Spring Harbor, the entire disclosure of which is incorporated herein by reference.

Using the methods and materials of the present invention, self-incompatibility may be induced, increased, decreased, repressed or otherwise altered, in a transformed plant relative to an untransformed control plant, for example by incorporating additional copies of a sense nucleic acid of the present invention, preferably to overexpress the polypeptide or in sense suppression. They may be decreased or otherwise altered, for example by incorporating an antisense nucleic acid of the present invention.

In a further aspect, the present invention provides a method for altering the SI status of a plant, said method including identifying a gene encoding a polypeptide which is active in the SI pathway of the plant and up-regulating or down-regulating expression of said gene to repress or induce the SI mechanism in said plant. Preferably said gene is a nucleic acid according to the present invention. Preferably the plant is as hereinbefore described.

By 'up-regulating' expression of said gene is meant increasing expression of said gene and, as a result, the protein encoded by the gene, in a plant relative to a control plant.

By 'down-regulating' expression of said gene is meant decreasing expression of said gene and, as a result, the protein encoded by the gene, in a plant relative to a control plant.

The up-regulation or down-regulation may be carried out by methods known to those skilled in the art. For example, a gene may be up-regulated by incorporating additional copies of a sense copy of the gene. A gene may be down-regulated, for example, by incorporating an antisense nucleic acid, a frame-shifted or otherwise modified sense copy of the gene, or nucleic acid encoding interfering RNA (RNAi). Up or down regulation may also be achieved through the use of transcription activator-like effector nucleases or zinc-finger nucleases, mediating cleavage of specific target sites in the nucleic acid, leading to micro-deletions and insertions within the endogenous nucleic acid sequence.

Techniques for incorporating the genetic constructs of the present invention into plant cells are known to those skilled in the art. Such techniques include high velocity projectile introduction to cells, tissues, calli, immature and mature embryos. Cells incorporating the genetic constructs of the present invention may be selected, as described above, and then cultured in an appropriate medium to regenerate transformed plants, using techniques well know in the art. The culture conditions, such as temperature, pH and the like, will be apparent to the person skilled in the art. The resulting plants may be reproduced either sexually or asexually, using methods well known in the art.

By 'repressing the SI mechanism' of a plant is meant reducing the tendency of the plant to inhibit pollen tube elongation and resulting fertilisation of self-pollen.

By 'activating the SI mechanism' of a plant is meant introducing the tendency of the plant to inhibit pollen tube elongation and resulting fertilisation of self-pollen.

In a further aspect, the present invention provides a substantially purified or isolated nucleic acid or nucleic acid fragment encoding a plant self-incompatibility (SI) protein, complements thereof, sequences antisense thereto, and functionally active fragments and variants thereof. Preferably, the nucleic acid or nucleic acid fragment encodes a polypeptide selected from the group consisting of a proteasome subunit, more particularly a 26S proteasome subunit, a Cullin (Cullins are molecular scaffolds responsible for assembling ubiquitin E3 ligases, more particularly RING-based E3 ubiquitin ligases), a glutamate receptor or precursor thereof, a zinc finger protease, a no-pollen (NOP) polypeptide, a seven-in-absentia homologue (SIAH), and a ubiquitin-specific protease, more particularly a ubiquitin-specific protease 22.

The nucleic acid or nucleic acid fragment may be isolated from or correspond to a gene from a plant of the Poaceae family. In a preferred embodiment the nucleic acid or nucleic acid fragment may be isolated from or correspond to a gene from a grass species, particularly a pasture grass such as ryegrass (*Lolium*) or fescue (*Festuca*), more particularly perennial ryegrass (*Lolium perenne* L.) or tall fescue (*Festuca arundinaceum*, otherwise known as *Lolium arundinaceum*).

By 'nucleic acid' is meant a chain of nucleotides capable of genetic information. The term generally refers to genes or functionally active fragments or variants thereof and or other sequences in the genome of the organism that influence its phenotype. The term 'nucleic acid' includes DNA (such as cDNA or genomic DNA) and RNA (such as mRNA or microRNA) that is single- or double stranded, optionally containing synthetic, non-natural or altered nucleotide bases, synthetic nucleic acids and combinations thereof.

Nucleic acids according to the invention may be full-length genes or part thereof, and are also referred to as "nucleic acid fragments" and "nucleotide sequences" in this specification. For convenience, the expression "nucleic acid or nucleic acid fragment" is used to cover all of these.

By 'substantially purified' is meant that the nucleic acid is free of the genes, which, in the naturally-occurring genome of the organism from which the nucleic acid of the invention is derived, flank the nucleic acid. The term therefore includes, for example, a nucleic acid which is incorporated into a vector; into an autonomously replicating plasmid or virus; or into the genomic DNA of a prokaryote or eukaryote;

or which exists as a separate molecule (e.g. a cDNA or a genomic or cDNA fragment produced by PCR or restriction endonuclease digestion) independent of other sequences. It also includes a nucleic acid which is part of a hybrid gene encoding additional polypeptide sequence. Preferably, the substantially purified nucleic acid is 90%, more preferably 95%, even more preferably 98% pure.

The term "isolated" means that the material is removed from its original environment (e.g. the natural environment if it is naturally occurring). For example, a naturally occurring nucleic acid present in a living plant is not isolated, but the same nucleic acid separated from some or all of the coexisting materials in the natural system, is isolated. Such nucleic acids could be part of a vector and/or such nucleic acids could be part of a composition, and still be isolated in that such a vector or composition is not part of its natural environment.

Such nucleic acids or nucleic acid fragments could be assembled to form a consensus contig. As used herein, the term "consensus contig" refers to a nucleotide sequence that is assembled from two or more constituent nucleotide sequences that share common or overlapping regions of sequence homology. For example, the nucleotide sequence of two or more nucleic acids or nucleic acid fragments can be compared and aligned in order to identify common or overlapping sequences. Where common or overlapping sequences exist between two or more nucleic acids or nucleic acid fragments, the sequences (and thus their corresponding nucleic acids or nucleic acid fragments) can be assembled into a single contiguous nucleotide sequence.

In a preferred embodiment, the present invention provides a substantially purified or isolated nucleic acid or nucleic acid fragment encoding a plant self-incompatibility (SI) protein, or complementary or antisense to a sequence encoding a plant SI protein, said nucleic acid or nucleic acid fragment including a nucleotide sequence selected from the group consisting of:
 (a) the sequences shown in SEQ ID NOS: 1 to 70;
 (b) a nucleotide sequence encoding the polypeptide shown SEQ ID NOS: 71 to 140;
 (c) complements of the sequences recited in (a) and (b);
 (d) sequences antisense to the sequences recited in (a) and (b);
 (e) functionally active fragments of the sequences recited in (a), (b), (c) and (d); and
 (f) functionally active variants of the sequences recited in (a), (b), (c), (d) and (e).

Preferably, the SI protein is selected from the group consisting of a proteasome subunit, more preferably a 26S proteasome subunit, a Cullin, a glutamate receptor or precursor thereof, a zinc finger protease, a protein containing C2 and GRAM amino acid domains, more preferably a protein involved in signal transduction, membrane trafficking, and/or membrane-coupled processes, more preferably a protein encoded by a NOP gene, a SIAH, and a ubiquitin-specific protease, more preferably a ubiquitin-specific protease 22.

In a preferred embodiment, the present invention provides a substantially purified or isolated nucleic acid or nucleic acid fragment encoding a proteasome subunit, more preferably a 26S proteasome subunit, or complementary or antisense to a sequence encoding a proteasome subunit, more preferably a 26S proteasome subunit, said nucleic acid or nucleic acid fragment including a nucleotide sequence selected from the group consisting of:
 (a) the sequences shown in SEQ ID NO: 58 and FIG. 3;
 (b) a nucleotide sequence encoding the polypeptide shown SEQ ID NO: 128;
 (c) complements of the sequences recited in (a) and (b);
 (d) sequences antisense to the sequences recited in (a) and (b);
 (e) functionally active fragments of the sequences recited in (a), (b), (c) and (d); and
 (f) functionally active variants of the sequences recited in (a), (b), (c), (d) and (e).

In a preferred embodiment, the present invention provides a substantially purified or isolated nucleic acid or nucleic acid fragment encoding a Cullin, or complementary or antisense to a sequence encoding a Cullin, said nucleic acid or nucleic acid fragment including a nucleotide sequence selected from the group consisting of:
 (a) the sequences shown in SEQ ID NO: 20 and FIG. 5;
 (b) a nucleotide sequence encoding the polypeptide shown SEQ ID NO: 90;
 (c) complements of the sequences recited in (a) and (b);
 (d) sequences antisense to the sequences recited in (a) and (b);
 (e) functionally active fragments of the sequences recited in (a), (b), (c) and (d); and
 (f) functionally active variants of the sequences recited in (a), (b), (c), (d) and (e).

In a preferred embodiment, the present invention provides a substantially purified or isolated nucleic acid or nucleic acid fragment encoding a glutamate receptor or precursor thereof, or complementary or antisense to a sequence encoding a glutamate receptor or precursor thereof, said nucleic acid or nucleic acid fragment including a nucleotide sequence selected from the group consisting of:
 (a) the sequences shown in SEQ ID NO: 39 and FIG. 7;
 (b) a nucleotide sequence encoding the polypeptide shown SEQ ID NO: 109;
 (c) complements of the sequences recited in (a) and (b);
 (d) sequences antisense to the sequences recited in (a) and (b);
 (e) functionally active fragments of the sequences recited in (a), (b), (c) and (d); and
 (f) functionally active variants of the sequences recited in (a), (b), (c), (d) and (e).

In a preferred embodiment, the present invention provides a substantially purified or isolated nucleic acid or nucleic acid fragment encoding a zinc finger protease, or complementary or antisense to a sequence encoding a zinc finger protease, said nucleic acid or nucleic acid fragment including a nucleotide sequence selected from the group consisting of:

(a) the sequences shown in SEQ ID NO: 62 and FIG. 9;
(b) a nucleotide sequence encoding the polypeptide shown SEQ ID NO: 132;
(c) complements of the sequences recited in (a) and (b);
(d) sequences antisense to the sequences recited in (a) and (b);
(e) functionally active fragments of the sequences recited in (a), (b), (c) and (d); and
(f) functionally active variants of the sequences recited in (a), (b), (c), (d) and (e).

In a preferred embodiment, the present invention provides a substantially purified or isolated nucleic acid or nucleic acid fragment encoding a C2 and GRAM domain containing polypeptide, preferably a no pollen (NOP) polypeptide, or complementary or antisense to a sequence encoding a C2 and GRAM domain containing polypeptide, preferably a no pollen (NOP) polypeptide, said nucleic acid or nucleic acid fragment including a nucleotide sequence selected from the group consisting of:
(a) the sequences shown in SEQ ID NO: 59 and FIG. 11;
(b) a nucleotide sequence encoding the polypeptide shown SEQ ID NO: 129;
(c) complements of the sequences recited in (a) and (b);
(d) sequences antisense to the sequences recited in (a) and (b);
(e) functionally active fragments of the sequences recited in (a), (b), (c) and (d); and
(f) functionally active variants of the sequences recited in (a), (b), (c), (d) and (e).

In a preferred embodiment, the present invention provides a substantially purified or isolated nucleic acid or nucleic acid fragment encoding a seven-in-absentia homologue, or complementary or antisense to a sequence encoding a seven-in-absentia homologue, said nucleic acid or nucleic acid fragment including a nucleotide sequence selected from the group consisting of:
(a) the sequences shown in SEQ ID NO: 40 and FIG. 13;
(b) a nucleotide sequence encoding the polypeptide shown SEQ ID NO: 110;
(c) complements of the sequences recited in (a) and (b);
(d) sequences antisense to the sequences recited in (a) and (b);
(e) functionally active fragments of the sequences recited in (a), (b), (c) and (d); and
(f) functionally active variants of the sequences recited in (a), (b), (c), (d) and (e).

In a preferred embodiment, the present invention provides a substantially purified or isolated nucleic acid or nucleic acid fragment encoding a ubiquitin-specific protease, more preferably a ubiquitin-specific protease 22, or complementary or antisense to a sequence encoding a ubiquitin-specific protease, more preferably a ubiquitin-specific protease 22, said nucleic acid or nucleic acid fragment including a nucleotide sequence selected from the group consisting of:
(a) the sequences shown in SEQ ID NO: 54 and FIG. 15;
(b) a nucleotide sequence encoding the polypeptide shown SEQ ID NO: 124;
(c) complements of the sequences recited in (a) and (b);
(d) sequences antisense to the sequences recited in (a) and (b);
(e) functionally active fragments of the sequences recited in (a), (b), (c) and (d); and
(f) functionally active variants of the sequences recited in (a), (b), (c), (d) and (e).

The present invention encompasses functionally active fragments and variants of the nucleic acids of the present invention. By 'functionally active' in relation to the nucleic acid is meant that the fragment or variant (such as an analogue, derivative or mutant) is capable of manipulating SI in a plant. For example, it may be capable of manipulating a proteasome in a plant, more particularly a proteasome subunit, even more particularly a 26S proteasome subunit. For example, it may be capable of manipulating an E3 ubiquitin ligase in a plant, more particularly a Cullin. For example, it may be capable of manipulating influx channels in a plant, more particularly glutamate receptors. For example, it may be capable of manipulating ubiquitin-specific protease activity in a plant, more particularly zinc finger protease activity. For example, it may be capable of manipulating signal transduction, membrane trafficking, and/or membrane-coupled processes in a plant. For example, it may be capable of manipulating SIAH in a plant. For example it may be capable of manipulating a ubiquitin-specific protease in a plant, more particularly a ubiquitin-specific protease 22.

Such variants include naturally occurring allelic variants and non-naturally occurring variants. Additions, deletions, substitutions and derivatizations of one or more of the nucleotides are contemplated so long as the modifications do not result in loss of functional activity of the fragment or variant. Preferably the functionally active fragment or variant has at least approximately 80% identity to the relevant part of the above mentioned sequence to which the fragment or variant corresponds, more preferably at least approximately 90% identity, even more preferably at least approximately 95% identity, most preferably at least approximately 98% identity. Such functionally active variants and fragments include, for example, those having conservative nucleic acid changes.

Particularly preferred fragments include fragments of the nucleic acid sequences which include hypervariable regions of the gametophytic gene in sense or anti sense orientation, and functionally active variants of these fragments, see FIGS. 17 to 37.

Preferably the fragment has a size of at least 20 nucleotides, more preferably at least 50 nucleotides, more preferably at least 100 nucleotides, more preferably at least 200 nucleotides, more preferably at least 500 nucleotides.

In a particularly preferred embodiment, the fragment or variant may include a sequence shown in FIGS. 17 to 37 hereto.

By 'conservative nucleic acid changes' is meant nucleic acid substitutions that result in conservation of the amino acid in the encoded protein, due to the degeneracy of the genetic code. Such functionally active variants and fragments also include, for example, those having nucleic acid changes which result in conservative amino acid substitutions of one or more residues in the corresponding amino acid sequence.

By 'conservative amino acid substitutions' is meant the substitution of an amino acid by another one of the same class, the classes being as follows:
Nonpolar: Ala, Val, Leu, Ile, Pro, Met Phe, Trp
Uncharged polar: Gly, Ser, Thr, Cys, Tyr, Asn, Gln
Acidic: Asp, Glu
Basic: Lys, Arg, His Other conservative amino acid substitutions may also be made as follows:
Aromatic: Phe, Tyr, His
Proton Donor: Asn, Gln, Lys, Arg, His, Trp
Proton Acceptor: Glu, Asp, Thr, Ser, Tyr, Asn, Gln In a further aspect of the present invention, there is provided a genetic construct including one or more nucleic acids according to the present invention.

In a preferred embodiment the genetic construct may include a chimeric sequence comprising a nucleic acid according to the present invention and a gene encoding a mediator or modulator of SI activity.

In another preferred embodiment, the genetic construct may include:
- a first nucleic acid or nucleic acid fragment encoding a SI polypeptide, wherein said first nucleic acid or nucleic acid fragment is isolated from or corresponds to a gene from the Z locus of a plant of the Poaceae family; and
- a second nucleic acid or nucleic acid fragment encoding a SI polypeptide, wherein said second nucleic acid or nucleic acid fragment is isolated from or corresponds to a gene from the S locus of a plant of the Poaceae family.

The term "genetic construct" as used herein refers to an artificially assembled or isolated nucleic acid molecule which includes the gene of interest. Preferably the genetic construct is a recombinant nucleic acid molecule. In general a construct may include the gene or genes of interest, a marker gene which in some cases can also be the gene of interest and appropriate regulatory sequences. It should be appreciated that the inclusion of regulatory sequences in a construct is optional, for example, such sequences may not be required in situations where the regulatory sequences of a host cell are to be used. The term construct includes vectors but should not be seen as being limited thereto.

By a 'chimeric sequence' is meant a hybrid produced by recombinant means through expression of a fusion gene including two or more linked nucleic acids which originally encoded separate proteins, or functionally active fragments or variants thereof.

By a 'fusion gene' is meant that two or more nucleic acids are linked in such a way as to permit expression of the fusion protein, preferably as a translational fusion. This typically involves removal of the stop codon from a nucleic acid sequence coding for a first protein, then appending the nucleic acid sequence of a second protein in frame. The fusion gene is then expressed by a cell as a single protein. The protein may be engineered to include the full sequence of both original proteins, or a functionally active fragment or variant of either or both.

In a preferred embodiment, the genetic construct according to the present invention may be a vector.

By a 'vector' is meant a genetic construct used to transfer genetic material to a target cell. The term vector encompasses both cloning and expression vectors. Vectors are often recombinant molecules containing nucleic acid molecules from several sources.

The vector may be of any suitable type and may be viral or non-viral. The vector may be an expression vector. Such vectors include chromosomal, non-chromosomal and synthetic nucleic acid sequences, e.g. derivatives of plant viruses; bacterial plasmids; derivatives of the Ti plasmid from *Agrobacterium tumefaciens*; derivatives of the Ri plasmid from *Agrobacterium rhizogenes*; phage DNA; yeast artificial chromosomes; bacterial artificial chromosomes; binary bacterial artificial chromosomes; vectors derived from combinations of plasmids and phage DNA. However, any other vector may be used as long as it is replicable or integrative or viable in the target cell.

In a preferred embodiment of this aspect of the invention, the vector may include a regulatory element such as a promoter, a nucleic acid or nucleic acid fragment according to the present invention and a terminator; said regulatory element, nucleic acid or nucleic acid fragment and terminator being operatively linked.

By a 'promoter' is meant a nucleic acid sequence sufficient to direct transcription of an operatively linked nucleic acid sequence.

By 'operatively linked' is meant that the nucleic acid(s) and a regulatory sequence, such as a promoter, are linked in such a way as to permit expression of said nucleic acid under appropriate conditions, for example when appropriate molecules such as transcriptional activator proteins are bound to the regulatory sequence. Preferably an operatively linked promoter is upstream of the associated nucleic acid.

By 'upstream' is meant in the 3'→5' direction along the nucleic acid.

The promoter and terminator may be of any suitable type and may be endogenous to the target cell or may be exogenous, provided that they are functional in the target cell.

The promoter used in the constructs and methods of the present invention may be a constitutive, tissue specific or inducible promoter. For example, the promoter may be a constitutive cauliflower mosaic virus (CaMV35S) promoter for expression in many plant tissues, an inducible 'photosynthetic promoter' (e.g. ribulose 1,5-bisphosphate), capable of mediating expression of a gene in photosynthetic tissue in plants under light conditions, or a tissue specific promoter such as a seed specific promoter, for example from a gene selected from the group consisting of *Brassica napus* napin gene, *Zea mays* zein 4 gene, *Orysa sativa* PR602 gene and *Triticum aestivum* glutelin gene.

A variety of terminators which may be employed in the genetic constructs of the present invention are also well known to those skilled in the art. The terminator may be from the same gene as the promoter sequence or a different gene. Particularly suitable terminators are polyadenylation signals, such as the (CaMV)35S polyA and other terminators from the nopaline synthase (nos) and the octopine synthase (ocs) genes.

The genetic construct, in addition to the promoter, the gene and the terminator, may include further elements necessary for expression of the nucleic acid, in different combinations, for example vector backbone, origin of replication (ori), multiple cloning sites, spacer sequences, enhancers, introns (such as the maize Ubiquitin Ubi intron), antibiotic resistance genes and other selectable marker genes [such as the neomycin phosphotransferase (nptII) gene, the hygromycin phosphotransferase (hph) gene, the phosphinothricin acetyltransferase (bar or pat) gene], and reporter genes (such as beta-glucuronidase (GUS) gene (gusA)]. The genetic construct may also contain a ribosome binding site for translation initiation. The genetic construct may also include appropriate sequences for amplifying expression.

Those skilled in the art will appreciate that the various components of the genetic construct are operably linked, so as to result in expression of said nucleic acid. Techniques for operably linking the components of the genetic construct of the present invention are well known to those skilled in the art. Such techniques include the use of linkers, such as synthetic linkers, for example including one or more restriction enzyme sites.

In a still further aspect, the present invention provides a substantially purified or isolated regulatory element capable of causing expression of an exogenous gene in plant cells. Preferably the regulatory element is isolated from a nucleic acid or nucleic acid fragment encoding a plant self-incompatibility (SI) protein and functionally active fragments and variants thereof. Preferably, the regulatory element is isolated from a nucleic acid or nucleic acid fragment encoding a proteasome subunit, more particularly a 26S proteasome subunit, a Cullin, a glutamate receptor or precursor thereof, a zinc finger protease, a polypeptide with both C2 and GRAM amino acid domains, more preferably a no-pollen (NOP) gene, a SIAH, or a ubiquitin-specific protease, more preferably a ubiquitin-specific protease 22.

The regulatory element may be a nucleic acid molecule, including DNA (such as cDNA or genomic DNA) and RNA (such as mRNA) that is single- or double-stranded, optionally containing synthetic, non-natural or altered nucleotide bases, and combinations thereof.

Preferably the regulatory element includes a promoter. In a preferred embodiment, the regulatory element includes a proteasome subunit gene promoter, more preferably a 26S proteasome subunit gene promoter. In another preferred embodiment the regulatory element includes a Cullin gene promoter. In another preferred embodiment the regulatory element includes a glutamate receptor or precursor gene promoter. In another preferred embodiment the regulatory element includes a zinc finger protease gene promoter. In another preferred embodiment the regulatory element includes a promoter from a polypeptide with both C2 and GRAM amino acid domains, more preferably a promoter from a no-pollen (NOP) gene. In another preferred embodiment the regulatory element includes a SIAH gene promoter. In another preferred embodiment the regulatory element includes a ubiquitin-specific protease gene promoter, more preferably a ubiquitin-specific protease 22 gene promoter.

Preferably the regulatory element may be isolated from or correspond to a regulatory element from a plant of the Poaceae family. In a preferred embodiment the regulatory element may be isolated from or correspond to a regulatory element from a grass species, particularly a pasture grass such as ryegrass (*Lolium*) or fescue (*Festuca*), more particularly perennial ryegrass (*Lolium perenne* L.) or tall fescue (*Festuca arundinaceum*, otherwise known as *Lolium arundinaceum*).

In a particularly preferred embodiment of this aspect of the invention, the regulatory element includes a promoter from a 26S proteasome subunit gene from perennial ryegrass.

Preferably the regulatory element includes a promoter element of the sequence shown in FIG. 3; or a functionally active fragment or variant thereof, including hypervariable regions. The person skilled in the art will understand that the promoter element is located upstream of the ATG start codon shown at position 2335 of FIG. 3.

In another particularly preferred embodiment of this aspect of the invention, the regulatory element includes a promoter from a Cullin gene from perennial ryegrass.

Preferably the regulatory element includes a promoter element of the sequence shown in FIG. 5; or a functionally active fragment or variant thereof, including hypervariable regions. The person skilled in the art will understand that the promoter element is located upstream of the ATG start codon shown at position 294 of FIG. 5.

In another particularly preferred embodiment of this aspect of the invention, the regulatory element includes a promoter from glutamate receptor or precursor gene from perennial ryegrass.

Preferably the regulatory element includes a promoter element of the sequence shown in FIG. 7; or a functionally active fragment or variant thereof, including hypervariable regions. The person skilled in the art will understand that the promoter element is located upstream of the ATG start codon shown at position 788 of FIG. 7.

In another particularly preferred embodiment of this aspect of the invention, the regulatory element includes a promoter from zinc finger protease gene from perennial ryegrass.

Preferably the regulatory element includes a promoter element of the sequence shown in FIG. 9; or a functionally active fragment or variant thereof, including hypervariable regions. The person skilled in the art will understand that the promoter element is located upstream of the ATG start codon shown at position 625 of FIG. 9.

In another particularly preferred embodiment of this aspect of the invention, the regulatory element includes a promoter from a NOP gene from perennial ryegrass.

Preferably the regulatory element includes a promoter element of the sequence shown in FIG. 11; or a functionally active fragment or variant thereof, including hypervariable regions. The person skilled in the art will understand that the promoter element is located upstream of the ATG start codon shown at position 7924 of FIG. 11.

In another particularly preferred embodiment of this aspect of the invention, the regulatory element includes a promoter from a SIAH gene from perennial ryegrass.

Preferably the regulatory element includes a promoter element of the sequence shown in FIG. 13; or a functionally active fragment or variant thereof, including hypervariable regions. The person skilled in the art will understand that the promoter element is located upstream of the ATG start codon shown at position 124 of FIG. 13.

In another particularly preferred embodiment of this aspect of the invention, the regulatory element includes a promoter from a ubiquitin-specific protease gene from perennial ryegrass.

Preferably the regulatory element includes a promoter element of the sequence shown in FIG. 15; or a functionally active fragment or variant thereof, including hypervariable regions. The person skilled in the art will understand that the promoter element is located upstream of the ATG start codon shown at position 6784 of FIG. 15.

By "functionally active" in this context is meant that the fragment or variant (such as an analogue, derivative or mutant) is capable of causing expression of a transgene in plant cells, particularly of the reproductive tissues. Such variants include naturally occurring allelic variants and non-naturally occurring variants. Additions, deletions, substitutions and derivatizations of one or more of the nucleotides are contemplated so long as the modifications do not result in loss of functional activity of the regulatory element. Preferably the functionally active fragment or variant has at least approximately 80% identity to the relevant part of the above mentioned sequence to which the fragment or variant corresponds, more preferably at least approximately 90% identity, even preferably at least approximately 95% identity, most preferably at least approximately 98% identity. Preferably the fragment has a size of at least 100 nucleotides, more preferably at least 150 nucleotides, most preferably at least 200 nucleotides.

In a particularly preferred embodiment of this aspect of the invention, the regulatory element includes a nucleotide sequence selected from the group consisting of:
Nucleotides 0 to 2334 of FIG. 3,
Nucleotides 500 to 2334 of FIG. 3, and
Nucleotides 1000 to 2334 of FIG. 3;
or a functionally active fragment or variant thereof.

In a particularly preferred embodiment of this aspect of the invention, the regulatory element includes a nucleotide sequence selected from the group consisting of: Nucleotides 0 to 293 of FIG. 5, and functionally active fragments and variants thereof.

In a particularly preferred embodiment of this aspect of the invention, the regulatory element includes a nucleotide sequence selected from the group consisting of: Nucleotides 0 to 787 of FIG. 7, and functionally active fragments and variants thereof.

In a particularly preferred embodiment of this aspect of the invention, the regulatory element includes a nucleotide sequence selected from the group consisting of: Nucleotides 0 to 624 of FIG. 9, and functionally active fragments and variants thereof.

In a particularly preferred embodiment of this aspect of the invention, the regulatory element includes a nucleotide sequence selected from the group consisting of:
Nucleotides 0 to 7923 of FIG. 11,
Nucleotides 6968 to 7923 of FIG. 11, and
Nucleotides 7468 to 7923 of FIG. 11,
or a functionally active fragment or variant thereof.

In a particularly preferred embodiment of this aspect of the invention, the regulatory element includes a nucleotide sequence selected from the group consisting of: Nucleotides 0 to 123 of FIG. 13, and functionally active fragments and variants thereof.

In a particularly preferred embodiment of this aspect of the invention, the regulatory element includes a nucleotide sequence selected from the group consisting of:
Nucleotides 0 to 6783 of FIG. 15,
Nucleotides 5087 to 6783 of FIG. 15,
Nucleotides 5587 to 6783 of FIG. 15, and
Nucleotides 6087 to 6783 of FIG. 15;
or a functionally active fragment or variant thereof.

By an "exogenous gene" is meant a gene not natively linked to said regulatory element. In certain embodiments of the present invention the exogenous gene is also not natively found in the relevant plant or plant cell.

The exogenous gene may be of any suitable type. The exogenous gene may be a nucleic acid such as DNA (e.g. cDNA or genomic DNA) or RNA (e.g. mRNA), and combinations thereof. The exogenous gene may be a gene capable of manipulating SI in a plant, or be a fragment or variant (such as an analogue, derivative or mutant) thereof which is capable of manipulating SI in a plant. Such variants include nucleic acid sequences which are antisense to said target gene or an analogue, derivative, mutant or fragment thereof. The transgene may code for a protein or RNA sequence depending on the target condition and whether down or up-regulation of gene expression is required.

The regulatory element according to the present invention may be used to express exogenous genes to which it is operatively linked in the production of transgenic plants. Preferably the regulatory element is used for gene expression in reproductive tissues of the plant.

Preferably, the genetic constructs of the present invention are substantially purified or isolated, as hereinbefore described. By 'substantially purified', in the current context, is meant that the genetic construct is free of the genes, which, in the naturally-occurring genome of the organism from which the nucleic acid or promoter of the invention is derived, flank the nucleic acid or promoter. The term therefore includes, for example, a genetic construct which is incorporated into a vector; into an autonomously replicating plasmid or virus; or into the genomic DNA of a prokaryote or eukaryote; or which exists as a separate molecule (e.g. a cDNA or a genomic or cDNA fragment produced by PCR or restriction endonuclease digestion) independent of other sequences. It also includes a genetic construct which is part of a hybrid gene encoding additional polypeptide sequence. Preferably, the substantially purified genetic construct is at least approximately 90% pure, more preferably at least approximately 95% pure, even more preferably at least approximately 98% pure.

As an alternative to use of a selectable marker gene to provide a phenotypic trait for selection of transformed host cells, the presence of the genetic construct in transformed cells may be determined by other techniques well known in the art, such as PCR (polymerase chain reaction), Southern blot hybridisation analysis, histochemical assays (e.g. GUS assays), thin layer chromatography (TLC), northern and western blot hybridisation analyses.

The genetic constructs and vectors of the present invention may be incorporated into a variety of plants, preferably monocotyledons, preferably of the Poaceae family, such as grasses from the genera *Lolium, Festuca, Paspalum, Pennisetum, Panicum* and other forage and turfgrasses, corn, oat, sugarcane, wheat and barley.

The genetic constructs of the present invention may be introduced into plants by any suitable technique. Techniques for incorporating the genetic constructs of the present invention into plant cells (for example by transduction, transfection, transformation or gene targeting) are well known to those skilled in the art. Such techniques include *Agrobacterium*-mediated introduction, *Rhizobium*-mediated introduction, electroporation to tissues, cells and protoplasts, protoplast fusion, injection into reproductive organs, injection into immature embryos and high velocity projectile introduction to cells, tissues, calli, immature and mature embryos, biolistic transformation, Whiskers transformation, and combinations thereof. The choice of technique will depend largely on the type of plant or fungus to be transformed, and may be readily determined by an appropriately skilled person. For transformation of protoplasts, PEG-mediated transformation is particularly preferred.

Cells incorporating the genetic constructs of the present invention may be selected, as described below, and then cultured in an appropriate medium to regenerate transformed plants, using techniques well known in the art. The culture conditions, such as temperature, pH and the like, will be apparent to the person skilled in the art. The resulting plants may be reproduced, either sexually or asexually, using methods well known in the art, to produce successive generations of transformed plants.

In a further aspect of the present invention there is provided a plant cell, plant, plant seed or other plant part, including, e.g. transformed with, a vector or construct, nucleic acid or nucleic acid fragment of the present invention. Preferably the plant cell is a transformed plant cell.

By a 'transformed plant cell' is meant a plant cell which has undergone transformation.

By 'transformation' is meant the transfer of nucleic acid into a plant cell.

By a 'transgene' is meant a nucleic acid suitable for transforming a plant cell.

The plant cell, plant, plant seed or other plant part may be from any suitable species. In a preferred embodiment the plant cell, plant, plant seed or other plant part may be from a monocotyledon, preferably of the Poaceae family, such as grasses from the genera *Lolium, Festuca, Paspalum, Pennisetum, Panicum* and other forage and turfgrasses, corn, oat, sugarcane, wheat and barley.

The present invention also provides a plant, plant seed or other plant part, or a plant extract derived from a plant cell or plant of the present invention and preferably including e.g. transformed with, a vector or construct, nucleic acid or nucleic acid fragment, or regulatory element of the present invention.

The nucleic acids or nucleic acid fragments of the present invention may be used to isolate cDNAs and genes encoding homologous SI proteins from the same or other plant species, using sequence-dependent protocols, such as methods of nucleic acid hybridisation, and methods of DNA and RNA amplification as exemplified by various uses of nucleic acid amplification technologies (e.g. polymerase chain reaction, ligase chain reaction).

For example, other 26S proteasome subunit genes, Cullin genes, glutamate receptor or precursor genes, zinc finger protease genes, NOP genes, SIAH genes, or ubiquitin-specific protease genes may be isolated directly by using all or a portion of the nucleic acids or nucleic acid fragments of the present invention as hybridisation probes to screen libraries from the desired plant employing the methodology well known to those skilled in the art. Specific oligonucleotide probes based upon the nucleic acid sequences of the present invention may be designed and synthesized by methods known in the art. Moreover, the entire sequences may be used directly to synthesize DNA probes by methods known to the skilled artisan such as random primer DNA labelling, nick translation, or end-labelling techniques, or RNA probes using available in vitro transcription systems. In addition, specific primers may be designed and used to amplify a part or all of the sequences of the present invention. The resulting amplification products may be labelled directly during amplification reactions or labelled after amplification reactions, and used as probes to isolate full-length cDNA or genomic fragments under conditions of appropriate stringency.

In addition, short segments of the nucleic acids or nucleic acid fragments of the present invention may be used in protocols to amplify longer nucleic acids or nucleic acid fragments encoding homologous genes from DNA or RNA. For example, polymerase chain reaction may be performed on a library of cloned nucleic acid fragments wherein the sequence of one primer is derived from the nucleic acid sequences of the present invention, and the sequence of the other primer takes advantage of the presence of the polyadenylic acid tracts to the 3' end of the mRNA precursor encoding plant genes. Alternatively, the second primer sequence may be based upon sequences derived from the cloning vector. For example, those skilled in the art can follow the RACE protocol (Frohman et al. (1988) *Proc. Natl. Acad USA* 85:8998, the entire disclosure of which is incorporated herein by reference) to generate cDNAs by using PCR to amplify copies of the region between a single point in the transcript and the 3' or 5' end. Using commercially available 3' RACE and 5' RACE systems (BRL), specific 3' or 5' cDNA fragments may be isolated (Ohara et al. (1989) *Proc. Natl. Acad Sci USA* 86:5673; Loh et al. (1989) *Science* 243:217, the entire disclosures of which are incorporated herein by reference). Products generated by the 3' and 5' RACE procedures may be combined to generate full-length cDNAs.

In a further aspect of the present invention there is provided a substantially purified or isolated SI polypeptide. Preferably, the SI polypeptide is selected from the group consisting of a proteasome subunit, more particularly a 26S proteasome subunit, a Cullin, a glutamate receptor or precursor thereof, a zinc finger protease, a polypeptide including both C2 and GRAM amino acid domains, more preferably a polypeptide encoded by a no-pollen (NOP) gene, a SIAH, and a ubiquitin-specific protease, more preferably a ubiquitin-specific protease 22.

The SI polypeptide may be isolated from or correspond to a polypeptide from a plant of the Poaceae family. In a preferred embodiment the SI polypeptide may be isolated from or correspond to a polypeptide from a grass species, particularly a pasture grass such as ryegrass (*Lolium*) or fescue (*Festuca*), more particularly perennial ryegrass (*Lolium perenne* L.) or tall fescue (*Festuca arundinaceum*, otherwise known as *Lolium arundinaceum*).

In a preferred embodiment, the present invention provides a substantially purified or isolated SI polypeptide, said polypeptide including an amino acid sequence selected from the group consisting of:
(a) sequences shown in SEQ ID NOS: 71 to 140 hereto;
(b) polypeptides encoded by the sequences shown in SEQ ID NOS: 1 to 70 hereto;
(c) functionally active fragments of the sequences recited in (a) and (b); and
(d) functionally active variants of the sequences recited in (a), (b) and (c).

In a preferred embodiment, the present invention provides a substantially purified or isolated proteasome subunit polypeptide, more particularly a 26S proteasome subunit polypeptide, said polypeptide including an amino acid sequence selected from the group consisting of:
(a) sequence shown in SEQ ID NO: 128 hereto;
(b) polypeptides encoded by the sequences shown in SEQ ID NO: 58 and FIG. 3 hereto;
(c) functionally active fragments of the sequences recited in (a) and (b); and
(d) functionally active variants of the sequences recited in (a), (b) and (c).

In a preferred embodiment, the present invention provides a substantially purified or isolated Cullin polypeptide, said polypeptide including an amino acid sequence selected from the group consisting of:
(a) sequence shown in SEQ ID NO: 90 hereto;
(b) polypeptides encoded by the sequences shown in SEQ ID NO: 20 and FIG. 5 hereto;
(c) functionally active fragments of the sequences recited in (a) and (b); and
(d) functionally active variants of the sequences recited in (a), (b) and (c).

In a preferred embodiment, the present invention provides a substantially purified or isolated glutamate receptor polypeptide or precursor thereof, said polypeptide including an amino acid sequence selected from the group consisting of:
(a) sequence shown in SEQ ID NO: 109 hereto;
(b) polypeptides encoded by the sequences shown in SEQ ID NO: 39 and FIG. 7 hereto;
(c) functionally active fragments of the sequences recited in (a) and (b); and
(d) functionally active variants of the sequences recited in (a), (b) and (c).

In a preferred embodiment, the present invention provides a substantially purified or isolated zinc finger protease polypeptide, said polypeptide including an amino acid sequence selected from the group consisting of:
(a) sequence shown in SEQ ID NO: 132 hereto;
(b) polypeptides encoded by the sequences shown in SEQ ID NO: 62 and FIG. 9 hereto;
(c) functionally active fragments of the sequences recited in (a) and (b); and
(d) functionally active variants of the sequences recited in (a), (b) and (c).

In a preferred embodiment, the present invention provides a substantially purified or isolated NOP polypeptide, said polypeptide including an amino acid sequence selected from the group consisting of:
(a) sequence shown in SEQ ID NO: 129 hereto;
(b) polypeptides encoded by the sequences shown in SEQ ID NO: 59 and FIG. 11 hereto;
(c) functionally active fragments of the sequences recited in (a) and (b); and
(d) functionally active variants of the sequences recited in (a), (b) and (c).

In a preferred embodiment, the present invention provides a substantially purified or isolated SIAH polypeptide, said polypeptide including an amino acid sequence selected from the group consisting of:
(a) sequence shown in SEQ ID NO: 110 hereto;
(b) polypeptides encoded by the sequences shown in SEQ ID NO: 40 and FIG. 13 hereto;
(c) functionally active fragments of the sequences recited in (a) and (b); and
(d) functionally active variants of the sequences recited in (a), (b) and (c).

In a preferred embodiment, the present invention provides a substantially purified or isolated ubiquitin-specific protease polypeptide, said polypeptide including an amino acid sequence selected from the group consisting of:
(a) sequence shown in SEQ ID NO: 124 hereto;
(b) polypeptides encoded by the sequences shown in SEQ ID NO: 54 and FIG. 15 hereto;
(c) functionally active fragments of the sequences recited in (a) and (b); and
(d) functionally active variants of the sequences recited in (a), (b) and (c).

The present invention encompasses functionally active fragments and variants of the polypeptides of the present invention. By 'functionally active' in this context is meant that the fragment or variant has one or more of the biological properties of the corresponding protein from which the fragment or variant is derived. Additions, deletions, substitutions and derivatizations of one or more of the amino acids are contemplated so long as the modifications do not result in loss of functional activity of the fragment or variant. Preferably the fragment or variant has at least approximately 80% identity to the relevant part of the above mentioned sequence to which the fragment or variant corresponds, more preferably at least approximately 90% identity, more preferably at least approximately 95% identity, most preferably at least approximately 98% identity. Such functionally active variants and fragments include, for example, those having conservative amino acid substitutions of one or more residues in the corresponding amino acid sequence.

By 'conservative amino acid substitutions' is meant the substitution of an amino acid by another one of the same class, the classes being as follows:
Nonpolar: Ala, Val, Leu, Ile, Pro, Met Phe, Trp
Uncharged polar: Gly, Ser, Thr, Cys, Tyr, Asn, Gln
Acidic: Asp, Glu
Basic: Lys, Arg, His Other conservative amino acid substitutions may also be made as follows:
Aromatic: Phe, Tyr, His
Proton Donor: Asn, Gln, Lys, Arg, His, Trp
Proton Acceptor: Glu, Asp, Thr, Ser, Tyr, Asn, Gln Preferably the fragment has a size of at least 10 amino acids, more preferably at least 20 amino acids, more preferably at least 50 amino acids, more preferably at least 100 amino acids, more preferably at least 200 amino acids.

In a particularly preferred embodiment, the fragment or variant may include a sequence shown in FIGS. 38 to 58 hereto.

In a further embodiment of this aspect of the invention, there is provided a polypeptide recombinantly produced from a nucleic acid or nucleic acid fragment according to the present invention. Techniques for recombinantly producing polypeptides are known to those skilled in the art.

Availability of the nucleotide sequences of the present invention and deduced amino acid sequences facilitates immunological screening of cDNA expression libraries. Synthetic peptides representing portions of the instant amino acid sequences may be synthesized. These peptides may be used to immunise animals to produce polyclonal or monoclonal antibodies with specificity for peptides and/or proteins including the amino acid sequences. These antibodies may be then used to screen cDNA expression libraries to isolate full-length cDNA clones of interest.

In a still further aspect of the present invention there is provided a method of isolating a nucleic acid or nucleic acid fragment of the present invention said method including sequencing nucleic acid fragments from a nucleic acid library.

The nucleic acid library may be of any suitable type and is preferably a cDNA library.

The nucleic acid or nucleic acid fragment may be isolated from a recombinant plasmid or may be amplified, for example using polymerase chain reaction.

The sequencing may be performed by techniques known to those skilled in the art.

In a still further aspect, the present invention involves identifying variation in the sequence of a gene encoding a polypeptide which is active in the SI pathway of a plant and deploying such variants as molecular markers. More particularly, the method includes determining the specific genetic constitution of a plant within the Poaceae family at the S and Z loci through analysis of genetic variation at the S and Z loci using methods known to those skilled in the art. This genetic variation may be in regions surrounding the SI genes and may be used in a proxy manner. Examples of sequence variation within the genes and their encoded polypeptides are shown in FIGS. 17 to 58.

Accordingly, the present invention provides use of a nucleic acid or nucleic acid fragment of the present invention or a SNP thereof as a molecular genetic marker.

More particularly, nucleic acids or nucleic acid fragments according to the present invention and/or nucleotide sequence information thereof may be used as a molecular genetic marker for quantitative trait loci (QTL) tagging, QTL mapping, DNA fingerprinting and in marker assisted selection, particularly in grasses such as *Lolium perenne*. Even more particularly, nucleic acids or nucleic acid fragments according to the present invention may be used as molecular genetic markers in plant improvement in relation to SI control or manipulation. Even more particularly, sequence information revealing SNPs in allelic variants of the nucleic acids or nucleic acid fragments of the present invention may be used as molecular genetic markers for QTL tagging and mapping and in marker assisted selection, particularly in grasses such as *Lolium perenne*.

As used herein, except where the context requires otherwise, the term "comprise" and variations of the term, such as "comprising", "comprises" and "comprised", are not intended to exclude further additives, components, integers or steps.

As used herein, except where the context requires otherwise, the singular forms "a", "an" and "the" include plural aspects.

DETAILED DESCRIPTION OF THE EMBODIMENTS

The present invention will now be more fully described with reference to the accompanying examples and figures. It should be understood, however, that the description following is illustrative only and should not be taken in any way as a restriction on the generality of the invention description above.

BRIEF DESCRIPTION OF THE DRAWINGS/FIGURES

In the figures:

FIG. 1. Comparative genetic ideogram of the S region delimited in *Lolium perenne* L. in comparison to the model genomes of *Oryza sativa* and *Brachypodium distachion*. Genes identified in common between *Oryza sativa* and *Brachypodium distachion* are indicated by joining lines. Assembled fragments of sequenced BAC clones from *Lolium perenne* L. are indicated along with their predicted location within the comparative genome map and their gene content. Gene content of the *Lolium perenne* L. nucleotide sequences are documented as orthologous genes based on the *Oryza* numerical numbering, with a Lp prefix.

Figure 2:
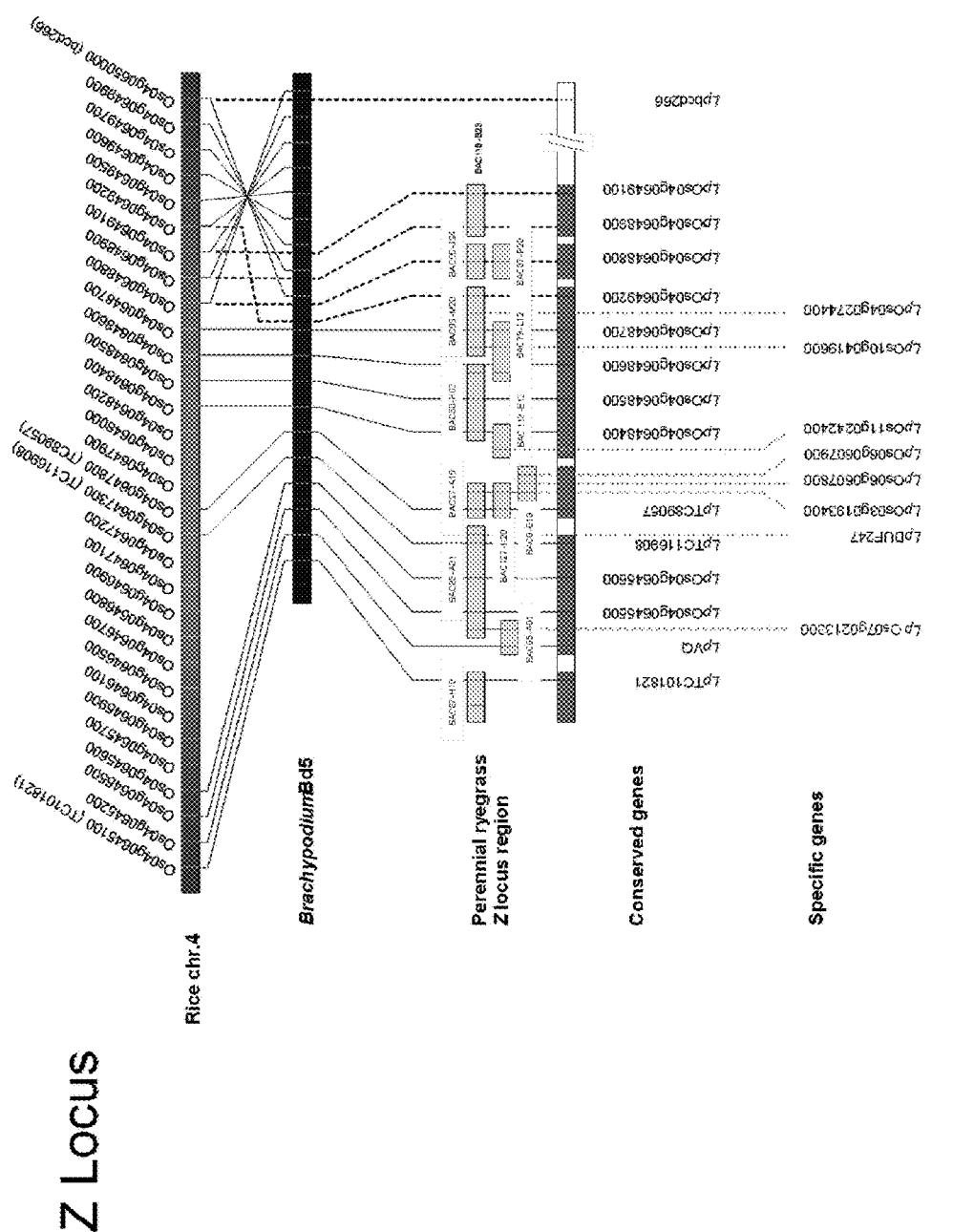

FIG. 2. Comparative genetic ideogram of the Z region delimited in *Lolium perenne* L. in comparison to the model genomes of *Oryza sativa* and *Brachypodium distachion*. Genes identified in common between *Oryza sativa* and *Brachypodium distachion* are indicated by joining lines. Assembled fragments of sequenced BAC clones from *Lolium perenne* L. are indicated along with their predicted location within the comparative genome map and their gene content. Gene content of the *Lolium perenne* L. nucleotide sequences are documented as orthologous genes based on the *Oryza* numerical numbering, with a Lp prefix.

FIG. 3. SEQ ID NO: 162, Nucleic acid sequence of the genomic clone that contains the *Lolium perenne* LpOs06g0607800 26S proteasome subunit gene (SEQ ID NO: 58) The initial codon (ATG) of the zinc finger protease gene is shown in bold italic underline.

Figure 4:
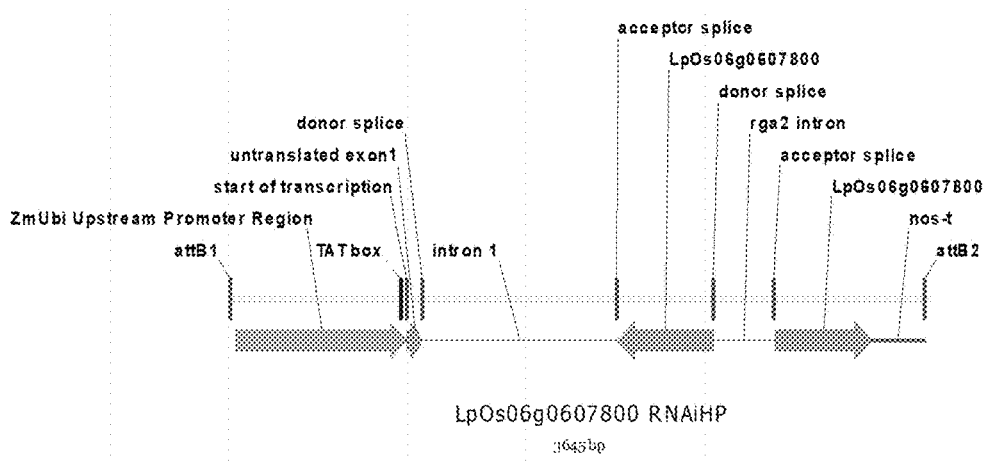

FIG. 4. Map of transformation vector containing the *Lolium perenne* ZmUbi_LpOs06g0607800_nos expression cassette used in biolistic mediated transformation of *Lolium perenne* L.

FIG. 5. SEQ ID NO: 163, Nucleic acid sequence of the genomic clone that contains the *Lolium perenne* LpOs05g0149600 Cullin gene. (SEQ ID NO: 20) The initial codon (ATG) of the Cullin gene is shown in bold italic underline.

Figure 6:
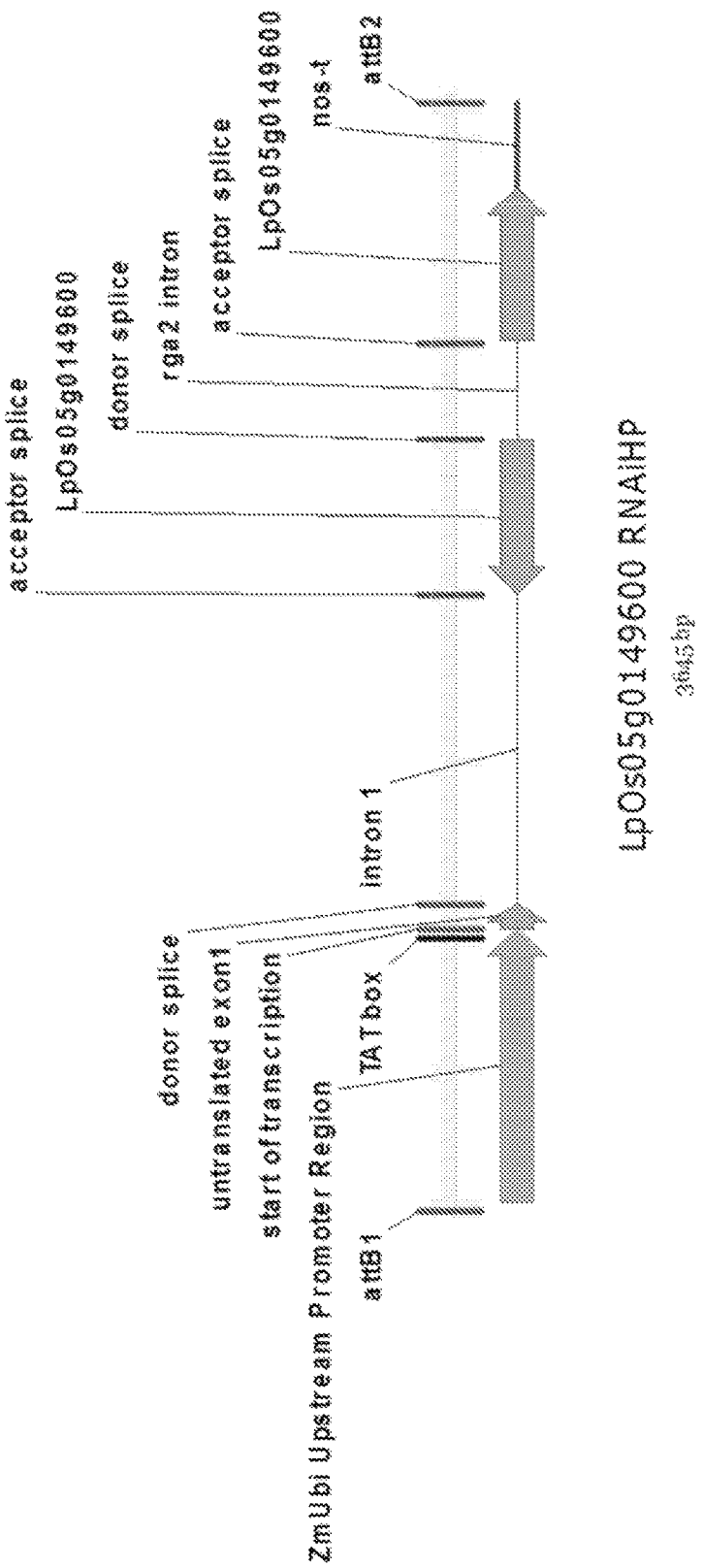

FIG. 6. Map of transformation vector containing the *Lolium perenne* ZmUbi_LpOs05g0149600_nos expression cassette used in biolistic mediated transformation of *Lolium perenne* L.

FIG. 7. SEQ ID NO: 164. Nucleic acid sequence of the genomic clone that contains the *Lolium perenne* LpOs06g0680500 Glutamate Receptor (LpGlu1) gene. (SEQ ID NO: 39) The initial codon (ATG) of the glutamate receptor gene is shown in bold italic underline.

Figure 8:
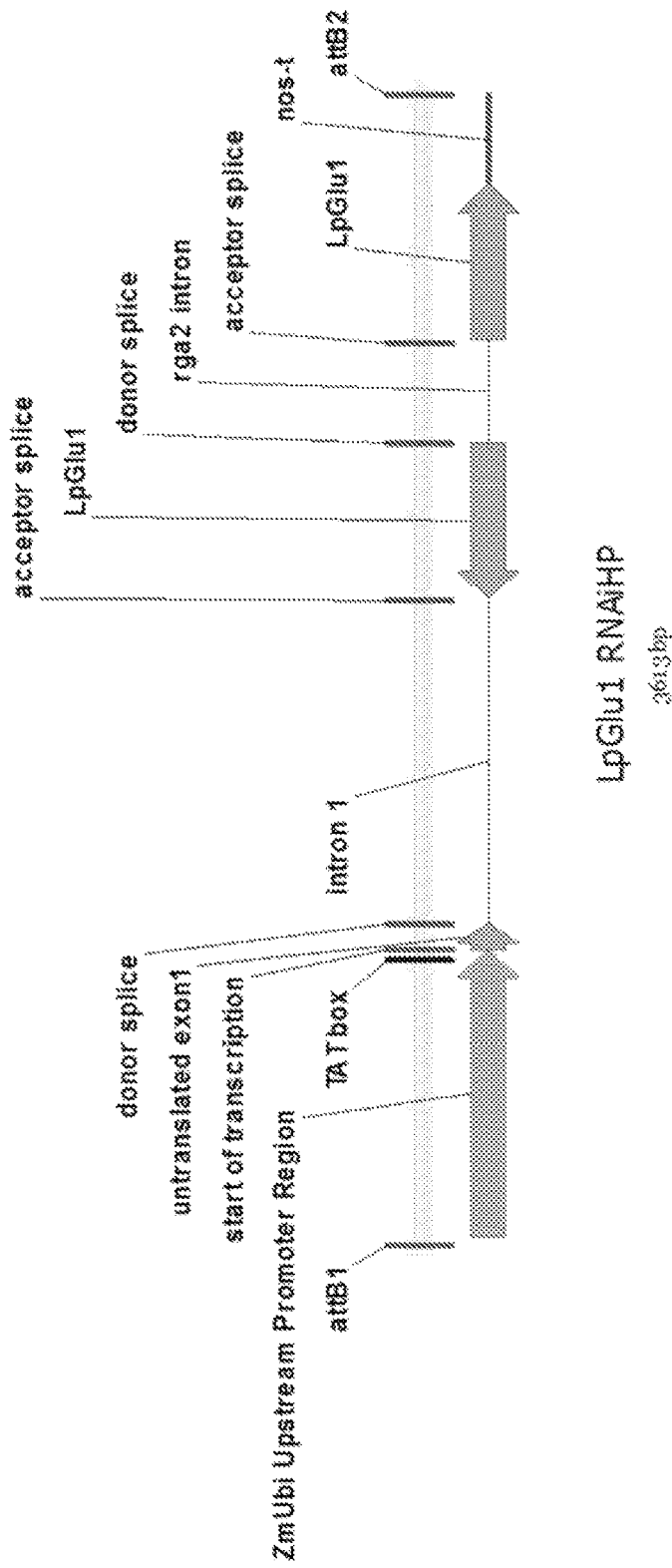

FIG. 8. Map of transformation vector containing the *Lolium perenne* ZmUbi_LpGlu1_nos expression cassette used in biolistic mediated transformation of *Lolium perenne* L.

FIG. 9. SEQ ID NO: 165, Nucleic acid sequence of the genomic clone that contains the *Lolium perenne* LpOs04g0648500 Ubiquitin-specific protease 22 including a zinc finger protease gene. (SEQ ID NO: 62) The initial codon (ATG) of the zinc finger protease gene is shown in bold italic underline.

Figure 10:
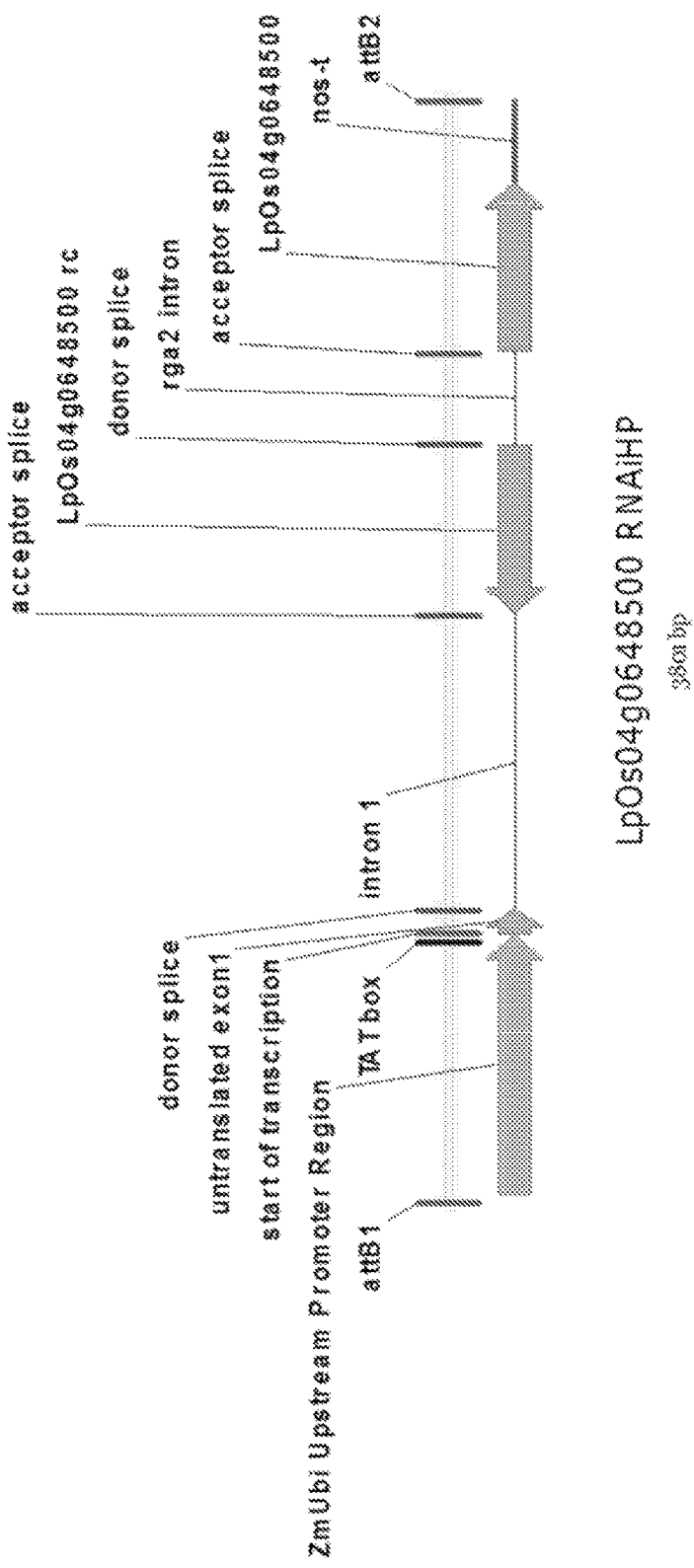

FIG. 10. Map of transformation vector containing the *Lolium perenne* ZmUbi_LpOs04g0648500_nos expression cassette used in biolistic mediated transformation of *Lolium perenne* L.

FIG. 11. SEQ ID NO: 166, Nucleic acid sequence of the genomic clone that contains the *Lolium perenne* LpOs06g0607900 No-Pollen (LpNOP) gene. (SEQ ID NO: 59) The initial codon (ATG) of the LpNOP gene is shown in bold italic underline.

Figure 12:
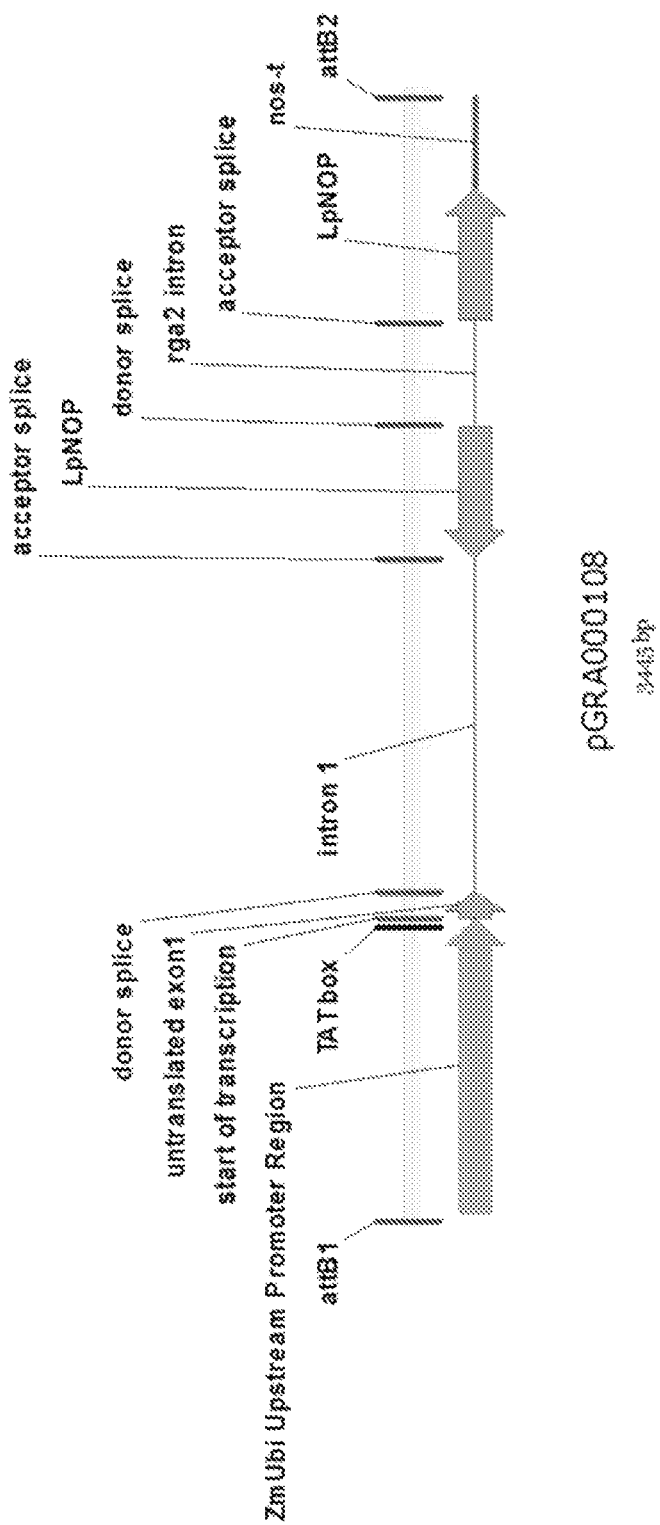

FIG. 12. Map of transformation vector containing the *Lolium perenne* ZmUbi_LpNOP_nos expression cassette used in biolistic mediated transformation of *Lolium perenne* L.

FIG. 13. SEQ ID NO: 167. Nucleic acid sequence of the genomic clone that contains the *Lolium perenne* LpOs05g0152900 Seven-In-Absentia Homolog (LpSIAH) gene. (SEQ ID NO: 40). The initial codon (ATG) of the LpSIAH gene is shown in bold italic underline.

Figure 14:
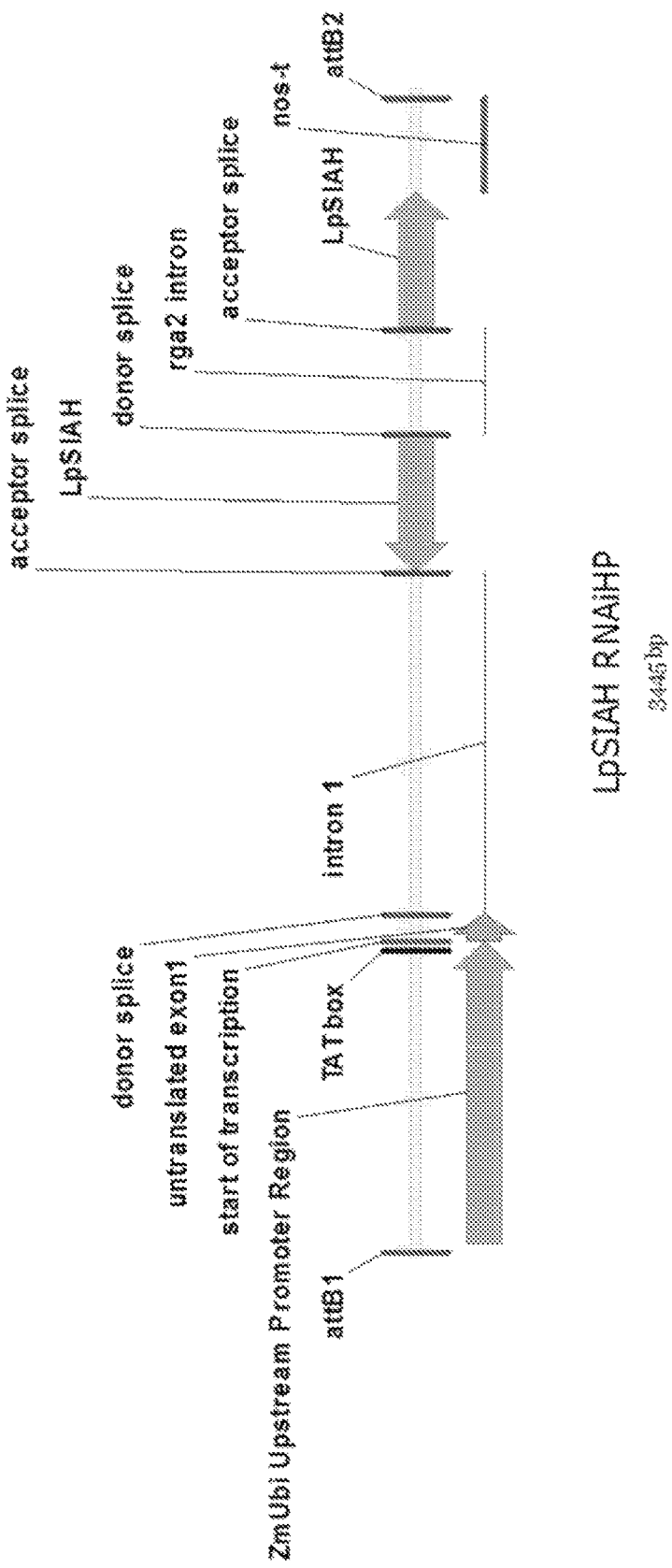

FIG. 14. Map of transformation vector containing the *Lolium perenne* ZmUbi_LpSIAH_nos expression cassette used in biolistic mediated transformation of *Lolium perenne* L.

FIG. 15. SEQ ID NO: 168, Nucleic acid sequence of the genomic clone that contains the *Lolium perenne* LpTC116908 gene. (SEQ ID NO: 54) The initial codon (ATG) of the LpTC116908 gene is shown in bold italic underline.

Figure 16:
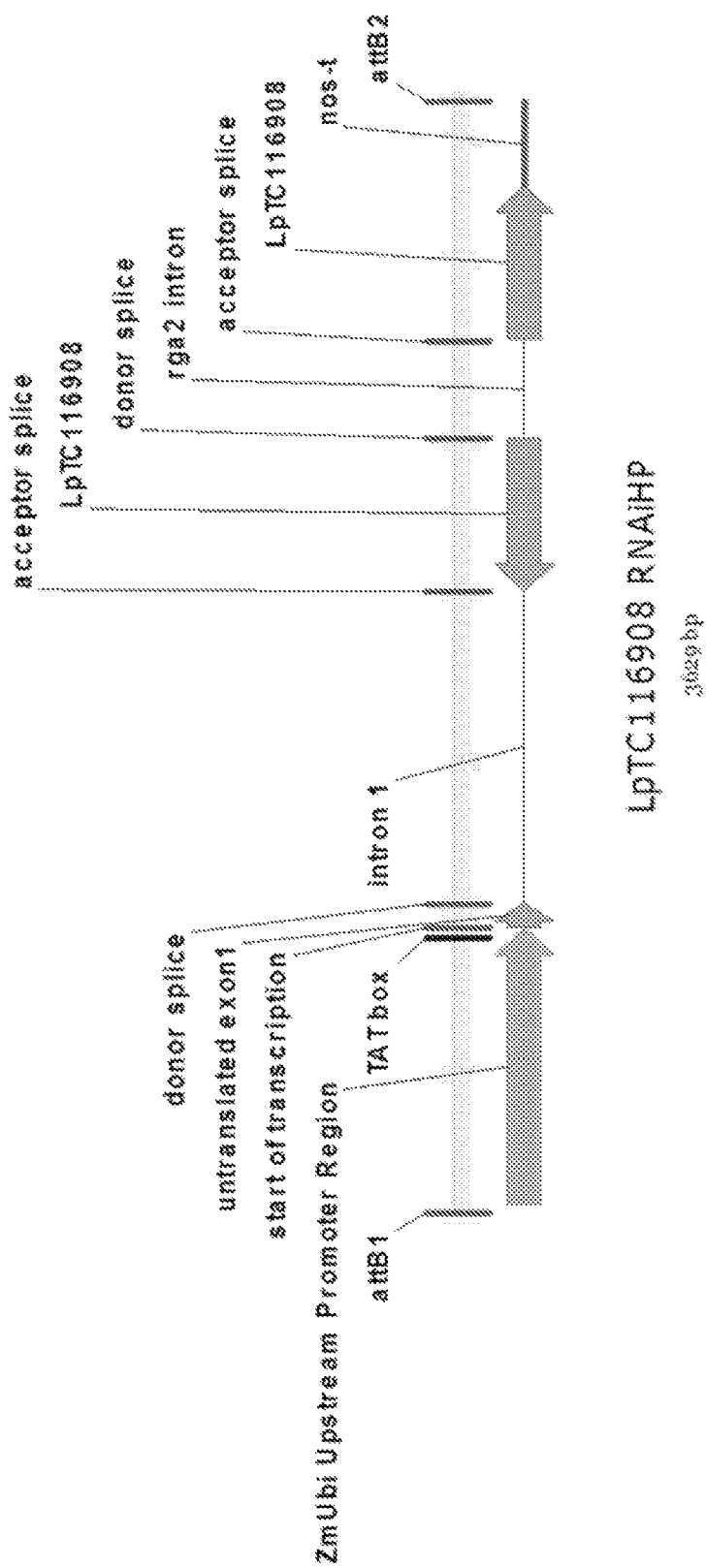

FIG. 16. Map of transformation vector containing the *Lolium perenne* ZmUbi_LpTC116908_nos expression cassette used in biolistic mediated transformation of *Lolium perenne* L.

FIGS. 17-28. SEQ ID NOs: 14, 15, 19, 20, 25, 23, 35, 38, 39, 40, and 42, respectively. S locus CDS variants. Detected sequence variation is identified within [ ] with both allelic forms described.

FIGS. 29-37. SEQ ID NOs: 52-54, 57-59, 62, 63 69 and 80, respectively. Z locus CDS variants. Detected sequence variation is identified within [ ] with both allelic forms described.

FIGS. 38-49. SEQ ID NOs: 80, 82, 85, 89, 90, 95, 96, 105, 108-110 and 112, respectively. Predicted Amino Acid translation showing S locus amino acid variants.

FIGS. 50-58. SEQ ID NOs: 122-124, 127-129, 132, 133 and 139, respectively. Predicted Amino Acid translation showing Z locus amino acid variants.

FIGS. 59-79. SEQ ID NOs: 141-161, respectively. Nucleic acid sequences of the ZmUbi_SI gene_nos expression cassettes used in biolistic mediated transformation of *Lolium perenne* L. Legend: Gateway attB1 site (bold underline); *Zea mays* Ubi promoter (italics)+intron (underlined italics); *Lolium perenne* coding region in antisense and sense orientations (underline); rga2 intron (bold); Nopaline synthase (nos) terminator (bold italics); Gateway attB2 site (bold underline)

Figure 80:
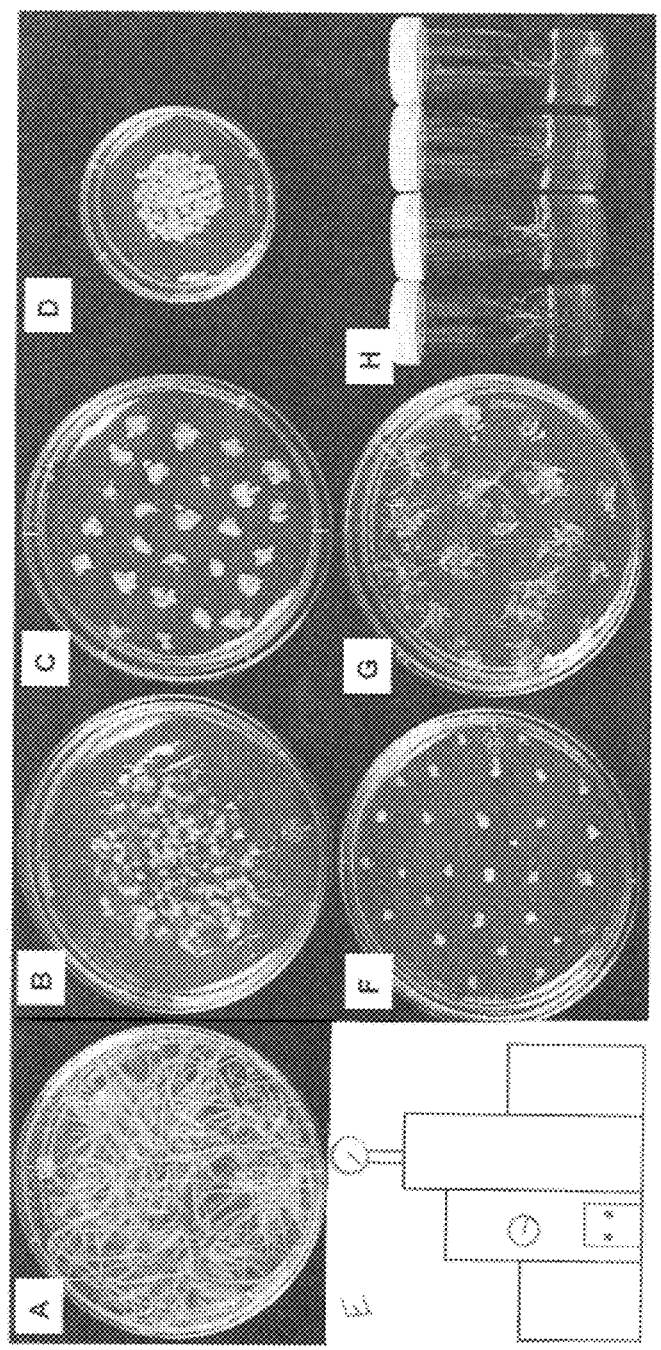

FIG. 80. Pictorial description of the transformation pipeline; A, preparation of donor ryegrass material; B, somatic embryo callus initiation; C, callus proliferation; D, osmotic treatment; E, biolistic delivery of transgene including expression cassette; F, callus growth on tissue culture medium including appropriate selection agent; G, regeneration of putative transgenic plant from callus; H, establishment of putative transgenic plant.

Figure 81:
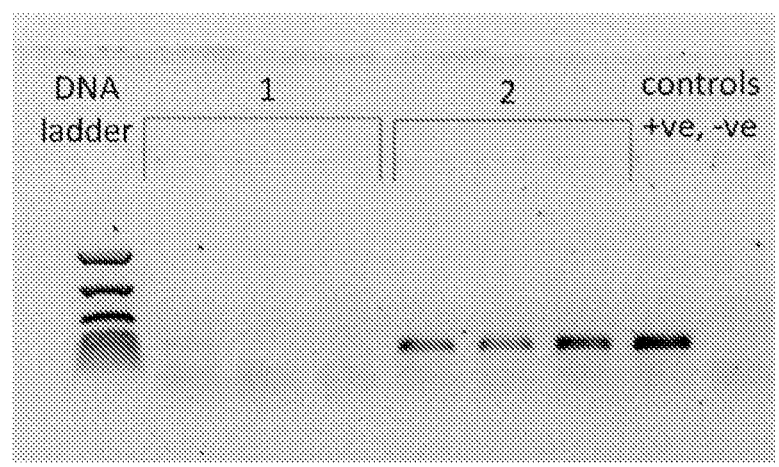

FIG. 81. PCR evaluation of transgenic status for individual tillers from regenerated transgenic events. Each transformation event was assessed through three individual tillers split from the regenerated plant. Only examples where all three tillers gave positive confirmation of the presence of the transgene, did the event get accepted for further evaluation. The brackets with numbers 1 and 2 in the figure identify 1, a transgenic event that would be discarded as all tillers are negative for the presence of the transgene and 2, a transgenic event where all three tillers have generated a positive result for the presence of the transgene.

FIGS. 82 A and B. FDA staining of viable pollen grains for example transgenic plants with SiRNA constructs for the down regulation of a candidate S and Z gene respectively. Both viable and non-viable pollen grains can be seen in both A and B.

Figure 83:
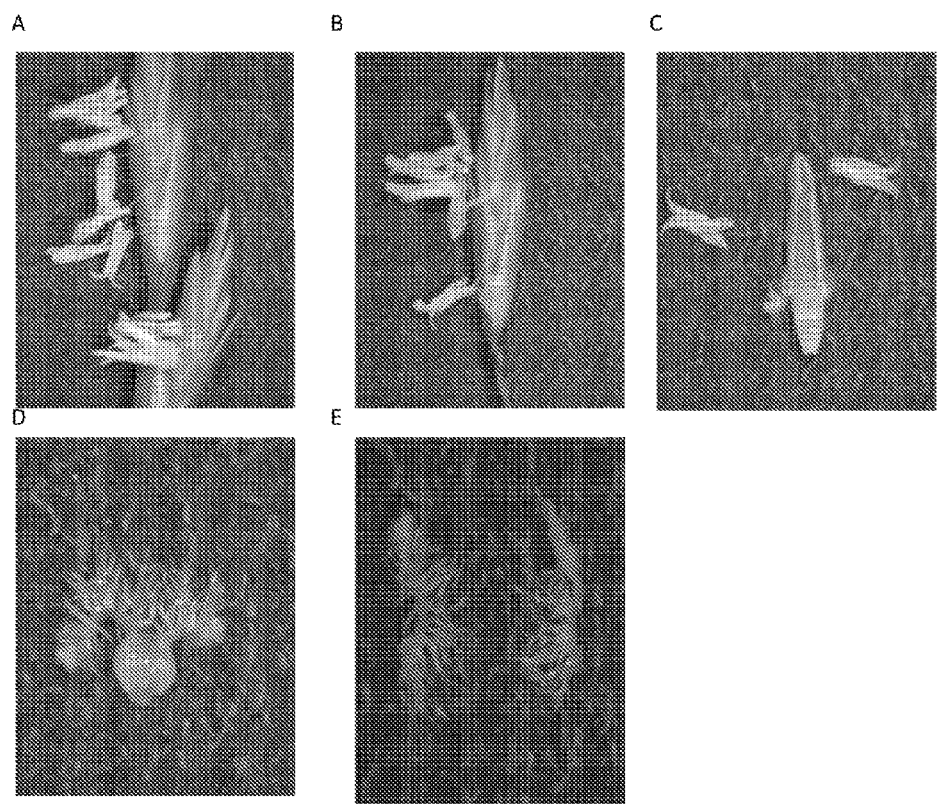

FIG. 83. Stages of ryegrass flower dissection. A—Intact flowers of ryegrass. Upon reaching reproductive maturity the anthers are released from the flower. The stigmatic papillae will then extend and become visible. B—individual spikelets were excised from a floral spike for further dissection. C—Both male and female reproductive tissues were excised from the spikelet. D and E—the female tissue was further excised to examine pollen tube growth on pollinated stigmas.

FIG. 84. Incompatible reaction of pollen tube growth. A and B, examples of single pollen grains germinating on stigmatic papillae and upon contact growth is arrested. The pollen tubes upon contact will often become swollen in shape through cytoplasmic pressure, indicated by arrows. C, An incompatible reaction of self pollination from a transgenic plant containing the SiRNA construct for LpOs05g0149600.

Figure 85:

FIG. 85. Compatible pollen tube growth with untransformed plants. Pollen was taken from unrelated ryegrass plants and placed upon an untransformed flower. The pollen tube has made contact with the stigmatic papillae and has then continued to grow in a directed manner towards the ovary. The pollen tube upon growth will deposit callose plugs at regular intervals (indicated by arrows) to retain cytoplasmic pressure, allowing the sperm cells to successfully migrate towards the ovary. These vacated regions will become vacuolated.

Figure 86:
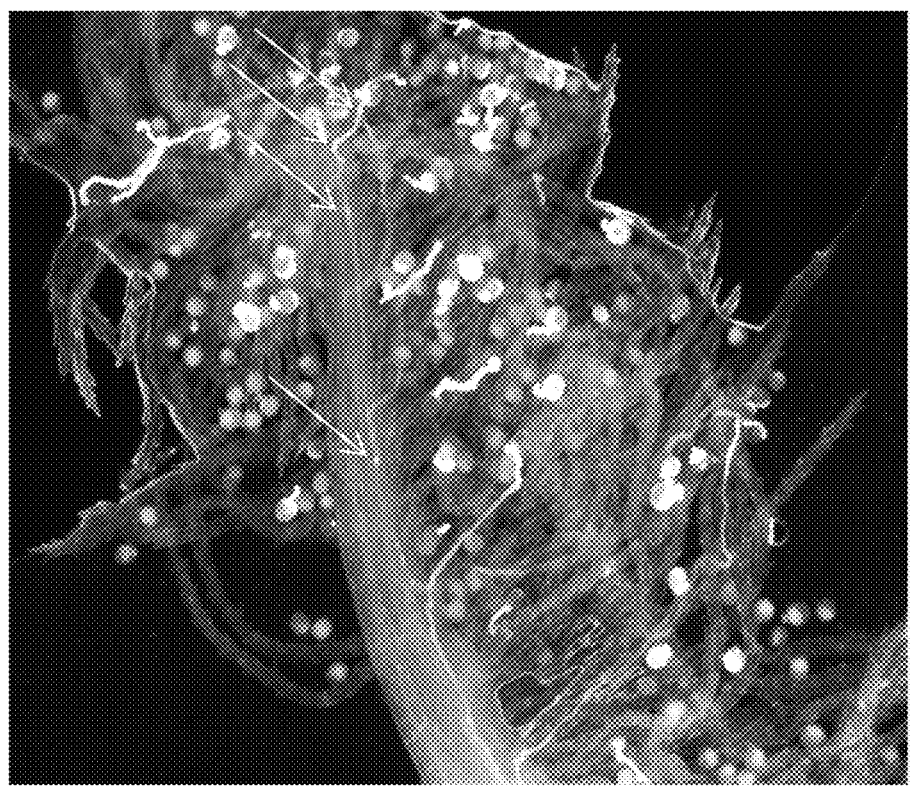

FIG. 86. Compatible pollen reaction. The pollen tube has made contact with the stigmatic papillae and has then continued to grow in a directed manner towards the ovary. The compatible pollen tube will deposit callose plugs at regular intervals (indicated by arrows). The reaction was observed on self-pollination of a transgenic plant containing the siRNA construct for the LpOs06g0680500.

Figure 87:
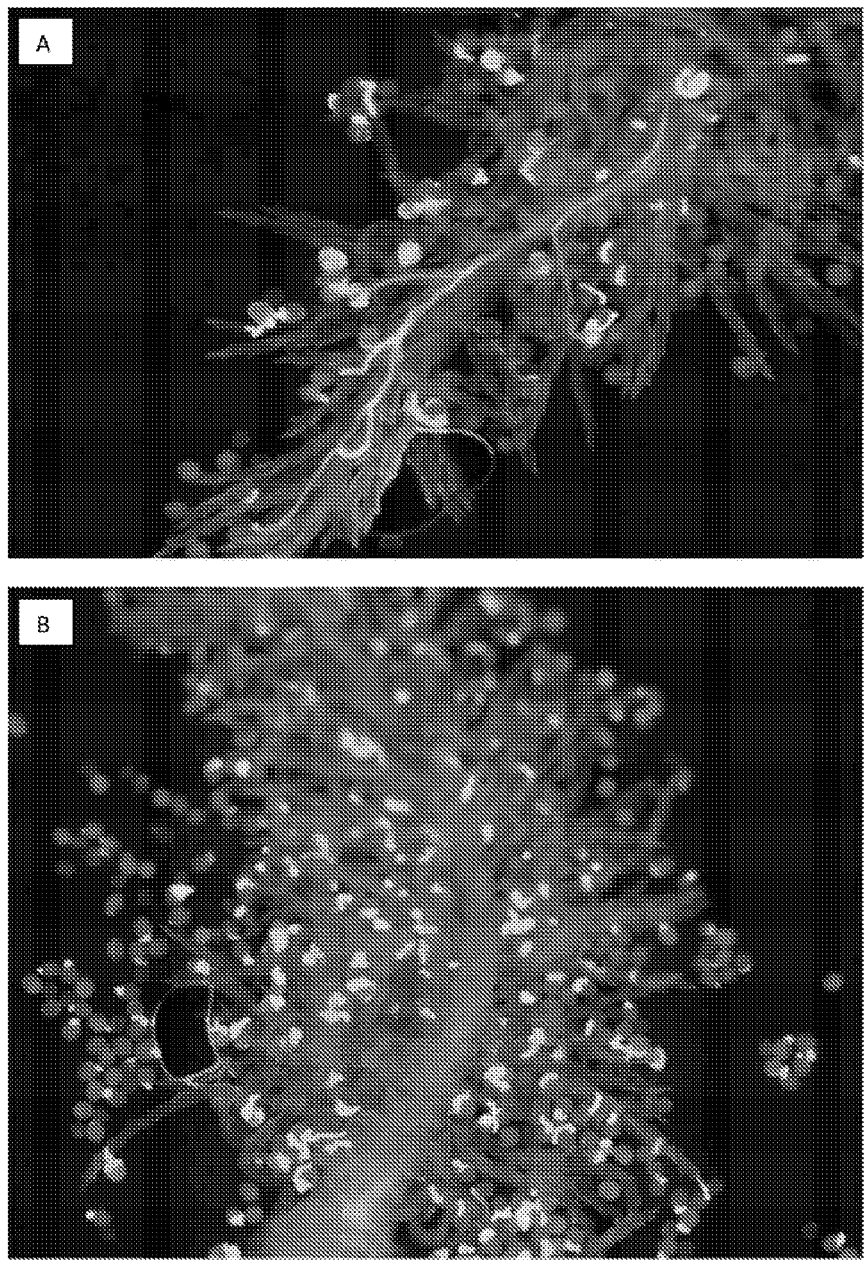
Figure 88:
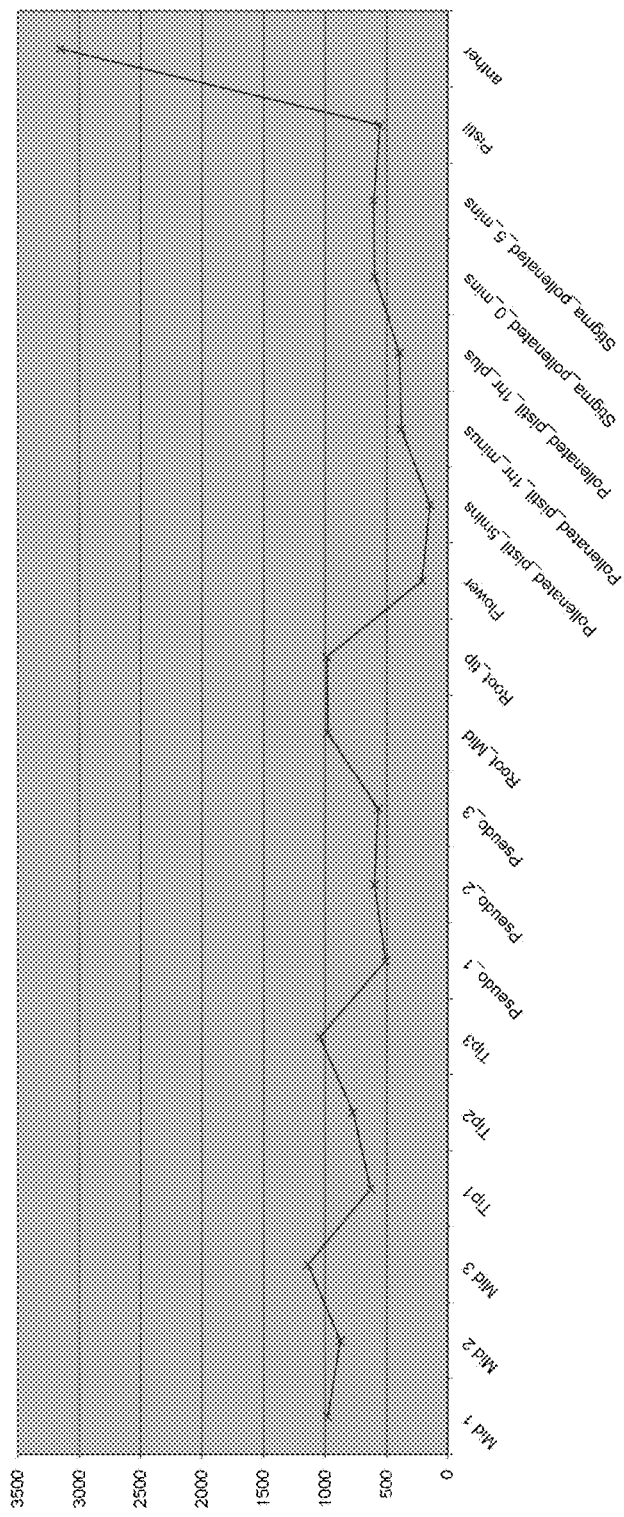
Figure 89:
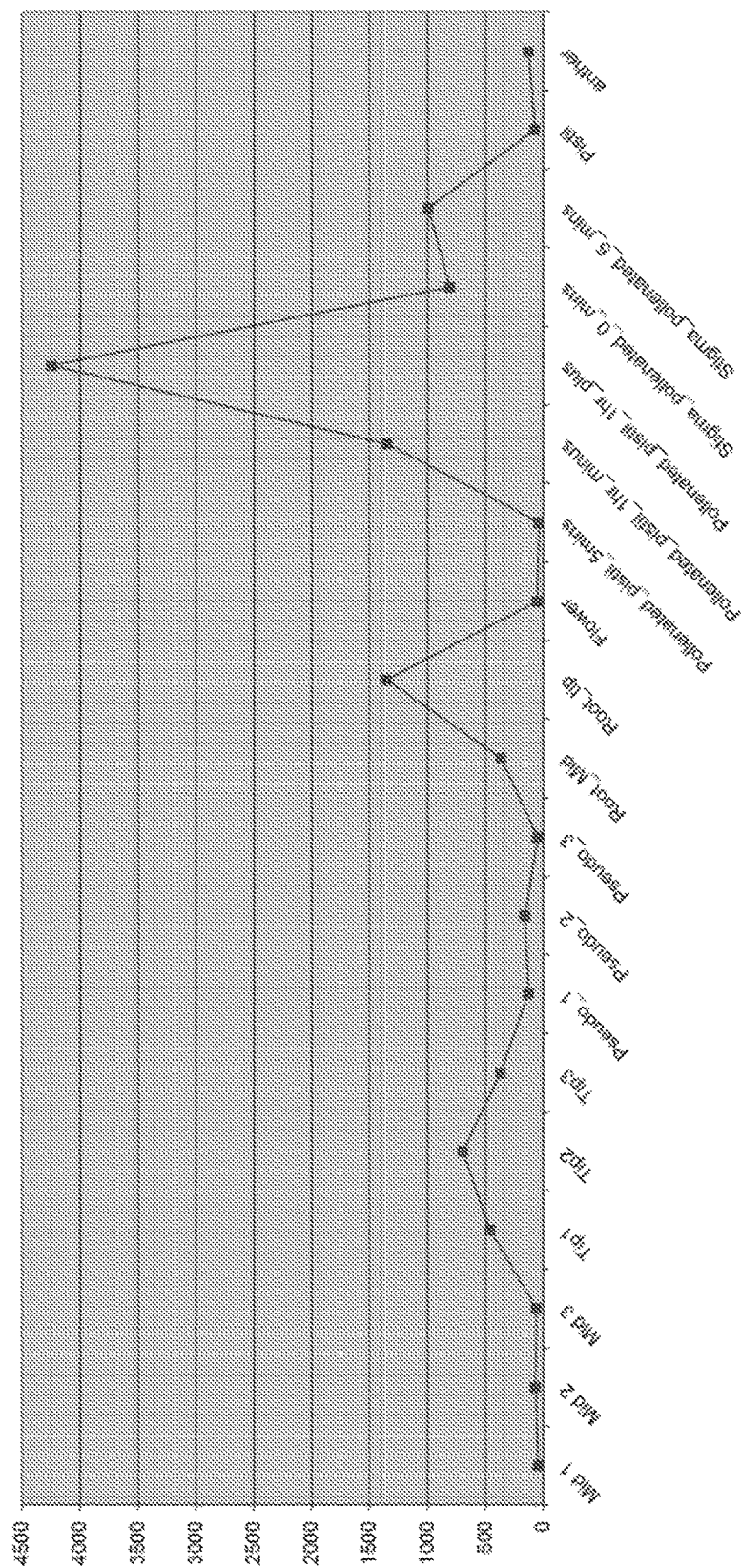
Figure 90:
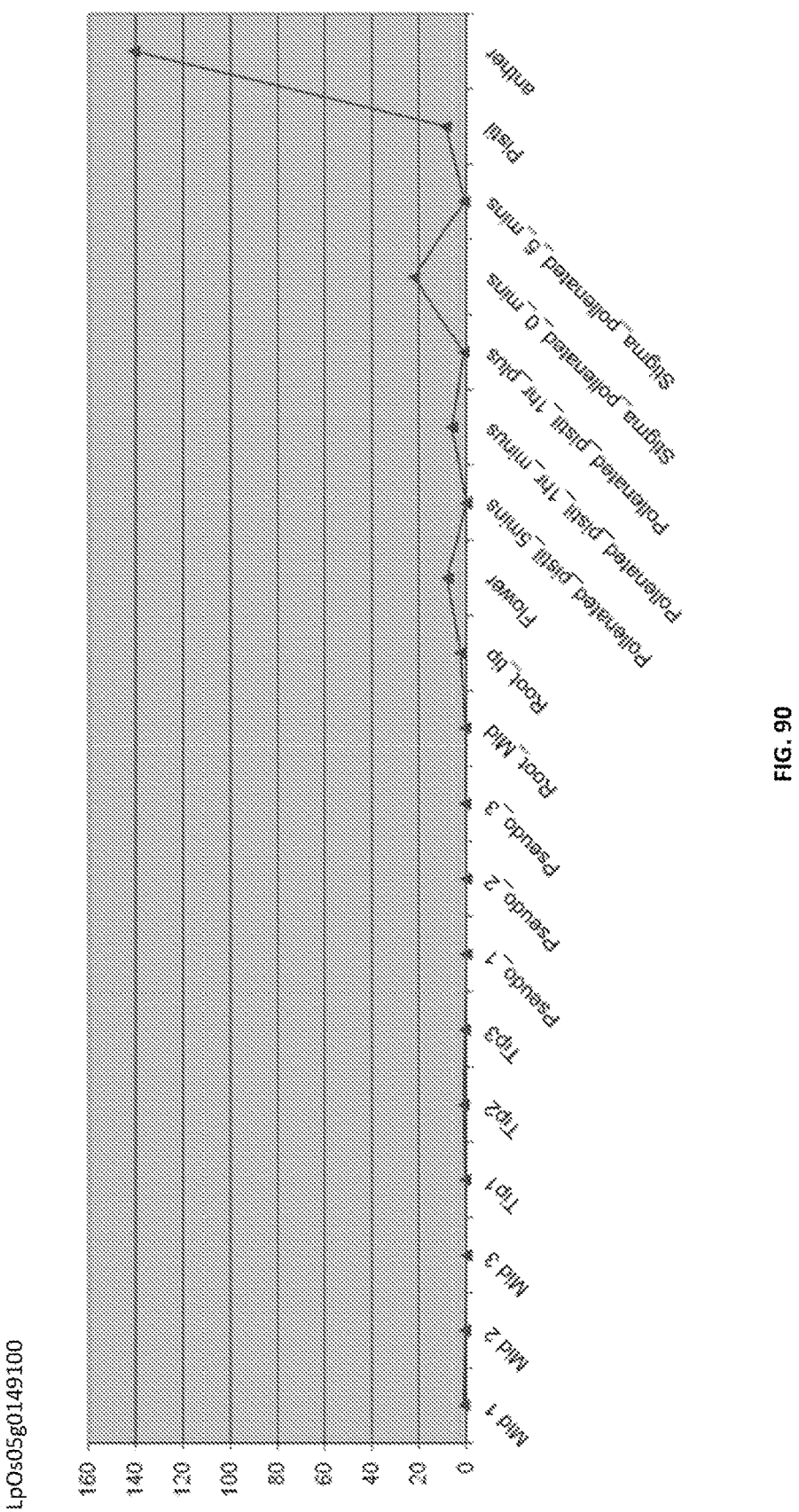
Figure 91:
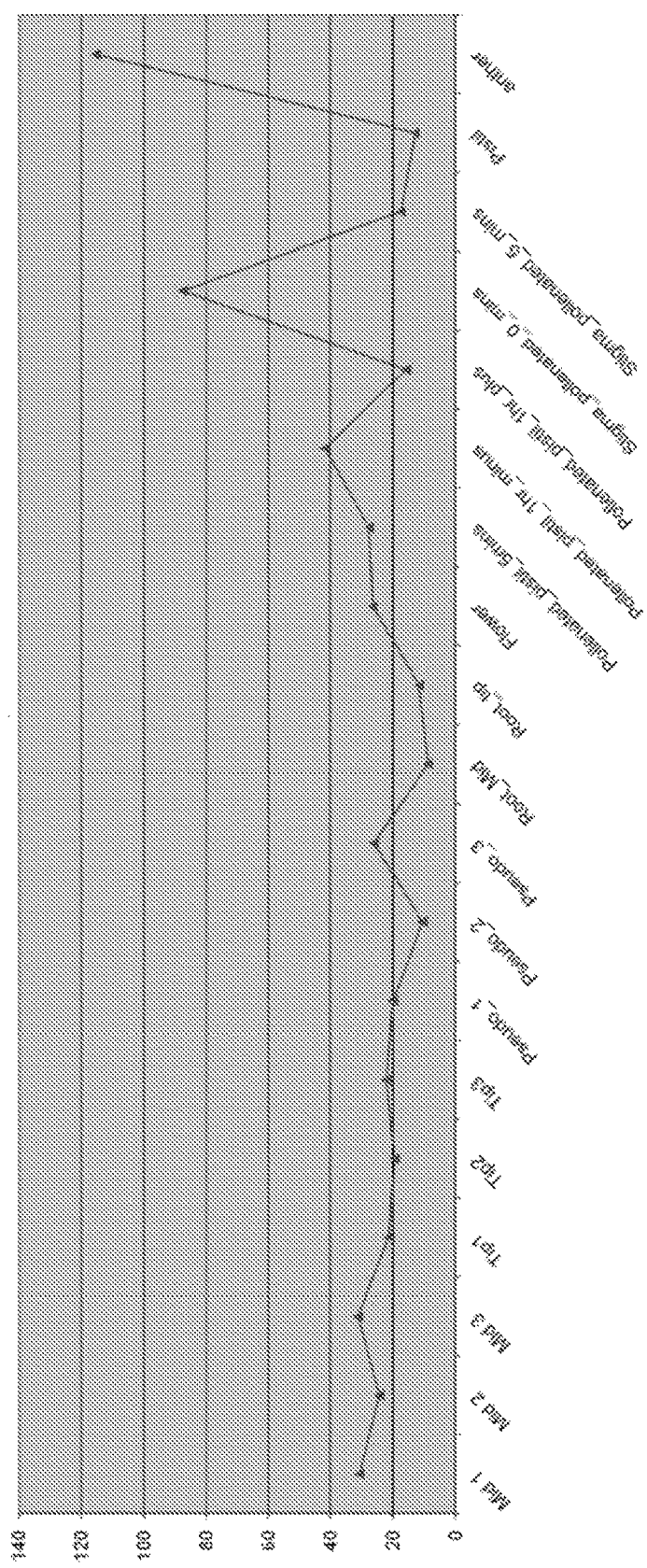

FIG. 87. Microscopic images of the pollen-stigma interaction of two different plants containing the siRNA construct for the LpOs05g0152900 gene. The two different transgenic events (A and B) show a range of phenotypes from incompatible to partially compatible.

FIGS. 88-108. Expression profiles of the *Lolium perenne* SI genes. Expression profiles were determined through BLAST analysis of sequence reads from multiple tissues of the *Lolium perenne* L. genotype Impact04, compared to the *Brachypodium distachion* CDS gene sequences used as orthologous templates.

Figure 109:
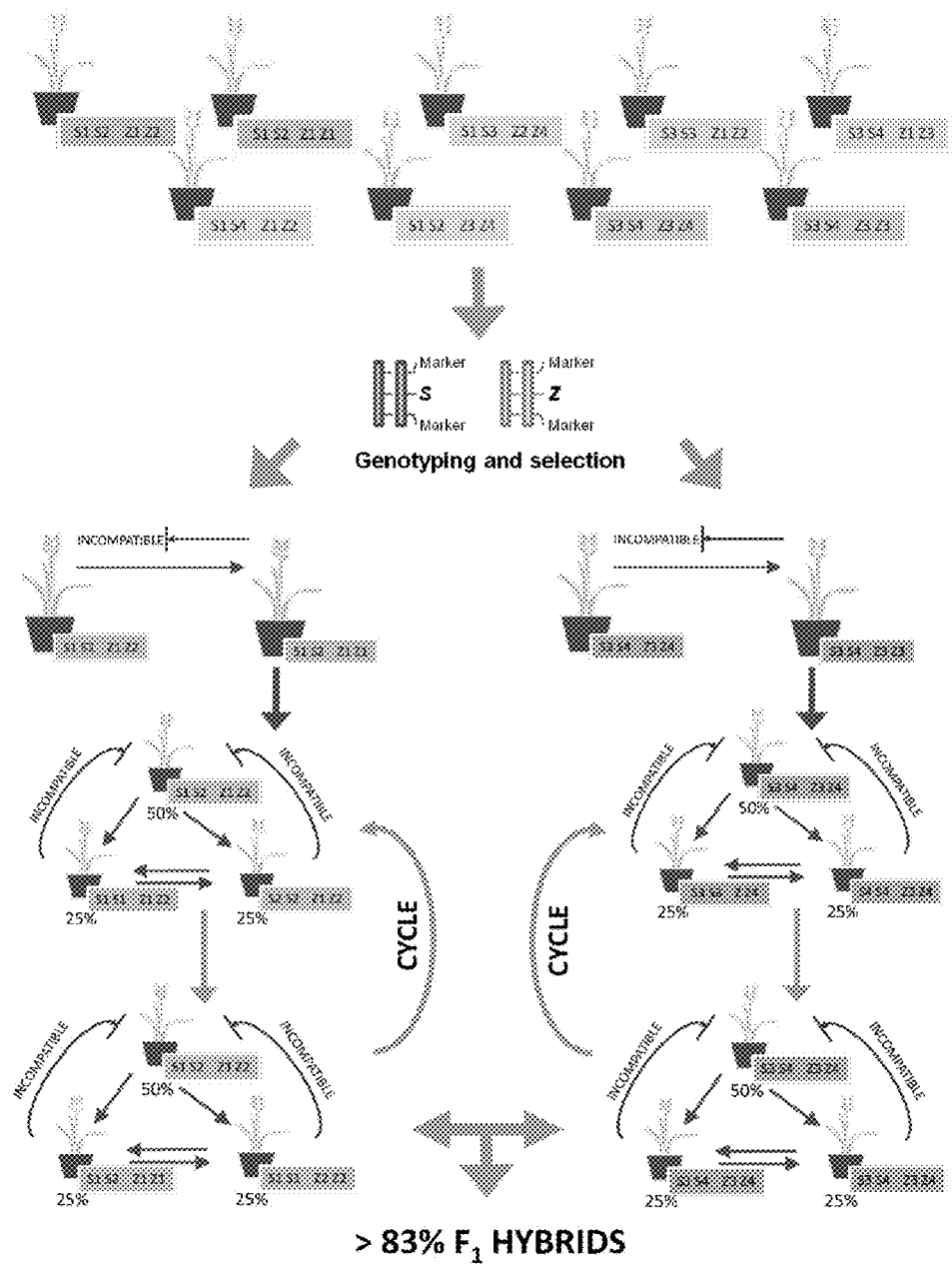

FIG. 109. Schematic diagram of F1 hybrid grass breeding. Plants are initially genotyped using markers on or around the S and Z loci. Two parental pools are then generated and multiplied, with testing of the degree of heterosis between pools once sufficient seed has been generated.

EXAMPLES

Example 1. Isolation of SI Genes

Both the S and Z locus was delimited through comparative genomics and BAC clone and genomic sequencing. All genes within the sequence data were identified (Tables 1 and 2). Sequences were determined through the FGENESH prediction software. Expression profiles were determined for each gene as described in Example 6. Expression profiles were determined through BLAST analysis of sequence reads from multiple tissues of the *Lolium perenne* L. genotype Impact04, compared to the *Brachypodium distachion* CDS gene sequences used as orthologous templates (See FIGS. 88-108).

TABLE 1

Genes identified within the S locus

| Ryegrass gene identified | Syn | Predicted Gene Function | Nucleic acid SEQ ID NO: | Polypeptide SEQ ID NO: |
|---|---|---|---|---|
| LpOs05g0481800 | | Protein prenyltransferase domain containing protein, pentatricopeptide repeat-containing protein | 1 | 71 |
| LpOs05g0147700 | | Cyclin-like F-box domain containing protein | 2 | 72 |
| LpOs05g0148300 | | Ribosomal protein S27, mitochondrial family protein | 3 | 73 |
| LpOs01g0254300 | | Similar to Pectinesterase-1 precursor (EC 3.1.1.11) (Pectin methylesterase 1) (PE 1) | 4 | 74 |
| LpOs08g0226800 | | TRAF-like domain containing protein, BTB/POZ and MATH domain-containing protein | 5 | 75 |
| LpOs05g0148400 | | Conserved hypothetical protein | 6 | 76 |
| LpOs05g0148500 | | Electron transport accessory protein domain containing protein | 7 | 77 |
| LpOs07g0118800 | | Conserved hypothetical protein | 8 | 78 |
| LpOs07g0118900 | | Cyclin-like F-box domain containing protein | 9 | 79 |

TABLE 1-continued

Genes identified within the S locus

| Ryegrass gene identified | Syn | Predicted Gene Function | Nucleic acid SEQ ID NO: | Polypeptide SEQ ID NO: |
|---|---|---|---|---|
| LpOs05g0148600 | | Na+/H+ antiporter | 10 | 80 |
| LpOs05g0148700 | | Armadillo-like helical domain containing protein, senescence associated protein | 11 | 81 |
| LpOs01g0372700 | | hypothetical protein, putative asparagine--tRNA ligase, cytoplasmic 1-like | 12 | 82 |
| LpOs05g0148900 | | Glutathione-S-transferase 19E50 | 13 | 83 |
| LpOs01g0369700 | | Similar to Glutathione S-transferase GST 8 | 14 | 84 |
| LpOs05g0149100 | | C2 calcium/lipid-binding region, CaLB domain containing protein | 15 | 85 |
| LpOs05g0149200 | | PWWP domain containing protein | 16 | 86 |
| LpOs05g0149300 | | 1-aminocyclopropane-1-carboxylate oxidase | 17 | 87 |
| LpOs05g0149400 | | 1-aminocyclopropane-1-carboxylic acid oxidase | 18 | 88 |
| LpOs05g0149500 | | Lipopolysaccharide-modifying protein family protein, predicted: O-glucosyltransferase rumi homolog | 19 | 89 |
| LpOs05g0149600 | | Cullin-1 | 20 | 90 |
| LpOs05g0149800 | | EF-Hand type domain containing protein, serine/threonine-protein phosphatase 2A regulatory subunit B" subunit gamma-like | 21 | 91 |
| LpOs05g0149900 | | Tetratricopeptide-like helical domain containing protein | 22 | 92 |
| LpOs05g0150000 | | putative proline synthetase associated protein | 23 | 93 |
| LpOs05g0150300 | | probable chromatin-remodelling complex ATPase chain-like protein | 24 | 94 |
| LpOs05g0150400 | | Double-stranded RNA binding domain containing protein | 25 | 95 |
| LpOs05g0150500 | | Conserved hypothetical protein, putative transport inhibitor response TIR1 | 26 | 96 |
| LpOs05g0150600 | | ATP-dependent DNA helicase RecQ family protein | 27 | 97 |
| LpOs10g0545800 | | Cytochrome biosynthesis CcmE/CycJ protein family protein | 28 | 98 |
| LpOs05g0150700 | | Heavy metal transport/detoxification protein domain containing protein | 29 | 99 |
| LpOs05g0150800 | | Similar to Plastid 5,10-methylene-tetrahydrofolate dehydrogenase, | 30 | 100 |
| LpOs05g0150900 | | Histidyl-tRNA synthetase | 31 | 101 |
| LpOs02g0508100 | | hypothetical protein containing DUF3339 | 32 | 102 |
| LpOs05g0151000 | Lpbcd762 | Similar to RNA polymerase II largest subunit | 33 | 103 |
| LpOs05g0151100 | | Conserved hypothetical protein, ferritin domain | 34 | 104 |
| LpOs05g0151300 | | Rubber elongation factor family protein | 35 | 105 |
| LpOs05g0151400 | | Chloroplast protein import component Toc86/159 family protein | 36 | 106 |
| LpSb07g026730 | | Putative uncharacterized protein | 37 | 107 |
| LpOs05g0152400 | | Glycosyl transferase, family 14 protein, xylosyltransferase-like | 38 | 108 |
| LpOs06g0680500 | | Glutamate receptor 3.4 precursor (Ligand-gated ion channel 3.4) | 39 | 109 |
| LpOs05g0152900 | | Seven in absentia protein family protein | 40 | 110 |
| LpOs05g0153000 | | Gelsolin family protein, villin-1-like | 41 | 111 |
| LpOs05g0153200 | | Region of unknown function, putative Zinc finger, XS and XH domain containing protein | 42 | 112 |

TABLE 1-continued

Genes identified within the S locus

| Ryegrass gene identified | Syn | Predicted Gene Function | Nucleic acid SEQ ID NO: | Polypeptide SEQ ID NO: |
|---|---|---|---|---|
| LpOs05g0153300 | | Lipase, class 3 family protein | 43 | 113 |
| LpOs05g0153400 | | predicted pentatricopeptide repeat-containing protein | 44 | 114 |
| LpOs05g0153600 | | FAR1 domain containing protein | 45 | 115 |
| LpOs05g0154500 | | Spc97/Spc98 family protein, gamma-tubulin complex | 46 | 116 |
| LpOs05g0154600 | | Similar to VIP2 protein, Hypothetical RING domain containing protein | 47 | 117 |
| LpOs01g0652800 | | Protein of unknown function DUF231, leaf senescence like protein, yellow leaf specific - like protein | 48 | 118 |
| LpOs07g0286100 | | Cyclin-like F-box domain containing protein; | | |

TABLE 2

Genes identified within the Z locus

| Ryegrass gene identified | Syn | Predicted Gene Function | Nucleic acid SEQ ID NO: | Poly peptide SEQ ID NO: |
|---|---|---|---|---|
| LpOs04g0645100 | LpTC101821 | Tetratricopeptide-like helical domain containing protein | 49 | 119 |
| LpOs04g0645200 | LpVQ | VQ domain containing protein | 50 | 120 |
| LpOs07g0213300 | | pentatricopeptide repeat-containing protein | 51 | 121 |
| LpOs04g0645500 | | methyltransferase-like protein 22-like | 52 | 122 |
| LpOs04g0645600 | | Protein of unknown function DUF6, transmembrane domain containing protein, vacuolar protein | 53 | 123 |
| LpOs04g0647300 | LpTC116908 | Ubiquitin-specific protease 22 | 54 | 124 |
| LpOs04g0647800 | LpTC89057 | Glycerol kinase 2 | 55 | 125 |
| LpOs04g0647701 | LpDUF247 | Protein of unknown function DUF247 | 56 | 126 |
| LpOs03g0193400 | | Polyamine oxidase precursor (EC1.5.3.11); | 57 | 127 |
| LpOs06g0607800 | | Similar to 26S proteasome regulatory complex subunit p42D | 58 | 128 |
| LpOs06g0607900 | | C2 and GRAM domain containing protein "No Pollen" | 59 | 129 |
| LpOs11g0242400 | | Rieske [2Fe—2S] region domain containing protein oxidoreductase | 60 | 130 |
| LpOs04g0648400 | | Leucine rich repeat, N-terminal domain containing protein | 61 | 131 |
| LpOs04g0648500 | | BRCA1-associated 2 domain containing protein, Ubiquitin RING domain containing | 62 | 132 |
| LpOs04g0648600 | | Conserved hypothetical protein | 63 | 133 |
| LpOs10g0419600 | | Chlorophyllase family protein | 64 | 134 |
| LpOs04g0648700 | | Conserved hypothetical protein | 65 | 135 |
| LpOs04g0274400 | | YL1 nuclear, C-terminal domain containing protein | 66 | 136 |

TABLE 2-continued

Genes identified within the Z locus

| Ryegrass gene identified | Syn | Predicted Gene Function | Nucleic acid SEQ ID NO: | Poly peptide SEQ ID NO: |
|---|---|---|---|---|
| LpOs04g0649200 | | Protein of unknown function DUF869, filament-like plant protein 7-like | 67 | 137 |
| LpOs04g0648800 | | RING-type domain containing protein, zinc finger binding | 68 | 138 |
| LpOs04g0648900 | | Dehydration responsive element binding protein 2F, AP2 domain containing | 69 | 139 |
| LpOs04g0649100 | | Pathogenesis-related transcriptional factor and ERF domain containing protein, AP2 domain containing, Apetala 2 like | 70 | 140 |
| LpOs04g0650000 | Lpbcd266 | Oryzain alpha chain precursor (EC 3.4.22.—) | | |

Example 2. Resequencing Data Identified DNA Nucleotide Variance

A cohort of 21 genes were selected as key candidates of the S and Z loci. The genes were selected based on expression profile as well as sequence annotation.

The collection of 21 genes all had PCR primers designed to resequence the coding regions of the genes. The designed PCR amplicons were optimised to generate large genomic fragments. A total of 50 plant genotypes were used as the template DNA for resequencing. The 50 plants were chosen as a diverse spread of plants with a potential wide range of diversity to maximise allelic variation at the genic loci being resequenced.

The amplicons were generated, then pooled from each genotype and physically sheared to smaller fragments. DNA bar codes and sequencing adaptors were ligated onto the sheared fragments to identify each sample and then all samples were combined and sequenced using a next-generation Illumina MiSeq platform with 300 bp×2 reads.

The resulting sequence data was attributed back to the individual samples using the bar codes and was then checked for quality and low quality reads removed. The sequence reads were then reference aligned to the genes amplified and variant bases identified. The individual samples were then combined to give a dataset to identify all variant bases from the 50 samples, with potentially 100 different alleles.

The variant bases were recorded for each gene to identify if the variation was synonymous or non-synonymous in nature. A minimalistic requirement for each of the genes under investigation would be to have 5 or more variant amino acids identified within the transcript. A total of 5 variant amino acids would enable a maximum of 32 potential haplotypes from the data set allowing complete random mating maximal recombination.

As 100 haplotypes were resequenced, high levels of diversity are expected, however there could be a degree of overlap between the haplotypes from the plants chosen so the total number of unique haplotypes could be lower than the number sequenced.

Perennial ryegrass has been characterised as having a high degree of sequence variation within its genome, with estimates ranging from 1 SNP every 20-30 bases within a gene bases on resequencing 2-4 haplotypes. With two exceptions all of the genes resequenced contained sufficient variation in the coding regions of the genes that would generate a sufficient diversity of polypeptides that could deliver the required allelic variability (See FIGS. 17 to 58). Detected sequence variation is identified within [ ] with both allelic forms described.

The genes LpOs05g0151300 and LpOs05g0152400 did not have sufficient diversity, with only 3 and 2 variant amino acids respectively.

Example 3—Isolation of SI Genes: Cloning of the Ryegrass LpOs06g0607800 26S Proteasome Gene In order to develop novel genetic markers for fine-scale genetic and physical mapping of the perennial ryegrass SI loci, linked heterologous cDNA-derived RFLP markers were selected for the S locus and Z on the basis of ortholocus co-segregation in cereal rye and/or blue canary grass. Molecular marker development, genetic mapping and region dissection is described in Shinozuka et al (2010). As a result of the assembled data sets fine-scale comparative sequence synteny with the model Poaceae species, specifically *Oryza sativa* and *Brachypodium distachyon*, was achieved for the delimited S and Z regions. Using the defined gene complement from the model Poaceae species, a BAC library was screened with primer pairs specific to the genes described and 39 specific clones were identified. The identity of the selected BAC clones was verified through direct sequencing of locus-specific amplicons. The specific BAC clones were then sequenced using Sanger and/or GSFLX technology and the resulting data was sequence assembled using the Newbler software package. Following sequencing and assembly gene-like nucleotide sequences were identified using BLAST and gene prediction software tools. Based on the derived information the reiteration of the procedure was performed for the selection of additional clones to further enhance the resolution and sequence data to assemble physical maps for the SI locus regions (FIGS. 1 and 2).

Molecular markers were developed from resequencing of specific genic loci, identified from the BAC sequencing and genetically mapped in a segregating population of *Lolium perenne* L. to confirm the location of the generated sequence.

The genome of a single *Lolium perenne* L. genotype (the plant—Impact04) has been sequenced to approximately 70× coverage, generating c. 2 billion sequencing reads of 100 by paired-end sequence reads on the Illumina GA2X and HiSeq2000 platform. The sequence data was filtered for high quality reads before being assembled using the SOAPdenovo v. 1.05 software package. The sequence assembly has been empirically optimised through iterative assessment of performance based on a range of input kmer sizes, in terms of number of bases assembled, and the average length of assembled contigs and scaffolds. An optimal assembly has generated 1.9 million scaffolds covering c. 1.7 Gb, while all contigs and singletons cover c. 3.5 Gb.

Comparison of contigs and scaffolds to the coding sequences of the model grass species *Brachypodium distachyon* L. permitted identification of putative perennial ryegrass orthologues to c. 86% of all predicted genes and alternate transcripts from the model grass species. A pipeline approach was implemented based on a highly parallel BLAST analysis method in order to group transcript and genomic sequences relevant to each individual *Brachypodium* gene sequence into individual local CAP3-based assemblies. This approach generated 23,285 genic files that were indexed to the corresponding *Brachypodium* gene. Development of the exome sequence library enabled identification of a large collection of genic contigs, along with the corresponding regulatory elements. The collection of contigs was then screened for the presence of the predicted genes within the S and Z loci that had not been identified through the BAC screening process.

A novel *Lolium perenne* L. gene was identified from BAC clone-related sequence that displayed sequence similarity with the rice gene Os06g0607800, hence the ryegrass gene was designated LpOs06g0607800 (SEQ ID NO: 58 and FIG. 3). The ryegrass gene was annotated as a 26S proteasome subunit gene through a BLASTx analysis (at e value=3e-65 compared to the rice amino acid sequence). The gene also contained an AAA ATPase domain (SEQ ID NO: 128).

In addition the ryegrass 26S proteasome subunit gene identified in the Z locus region through BAC sequencing, was compared through BLAST analysis to the genomic Impact04 sequence through BLAST analysis. The identification of the sequence from the BAC clones as well as the genomic sequence enabled the identification of variant sequence bases from the coding region of the gene (FIGS. 33 and 54).

Intracellular proteolysis is mainly regulated and enabled through the ubiquitin-proteasome pathway or the autophagy-lysozome/vacuole pathway. Proteolytic events play significant roles in SI through self-pollen rejection. Ubiquitin-mediated proteolysis is involved in the SI mechanism of the Brassicaceae and the Solanaceae.

The 26S proteasome consists of the 20S core proteasome (CP) element and the 19S regulatory particle (RP). Proteolysis occurs in the 20S compartment, while the 19S element confers ATP dependence and substrate specificity to the CP. The RP consists of two elements: a ring of six AAA-ATPase subunits (often abbreviated as RPT) that is expected to function in target unfolding and transport, and three non-ATPase subunits (often abbreviated as RPN). As the 26S Proteasome subunit gene LpOs06g0607800 contains the AAA-ATPase domain, it is of the class RPT.

*Arabidopsis thaliana* L. mutant lines, in which the RTP2 subunit of the 26S proteasome gene is disrupted, have demonstrated that male and female gamete transmission require a normal copy of the RPT2 gene to avoid abortion and failure in gametogenesis. In tobacco (*Nicotiana tabacum* L.) the NtRpn3 gene was found to physically interact with a calcium-dependent protein kinase and become phosphorylated in a calcium dependent manner.

While applicants do not wish to be restricted by theory, the LpOs06g0607800 26S Proteasome gene is hence proposed to be the female determinant of the Z locus.

Example 4—Generation of Transformation Vectors Containing an Inverted Hairpin Structure of the LpOs06g0607800 26S Proteasome Gene The LpOs06g0607800 expression cassette consists of the promoter, 5' untranslated region and intron from the Ubiquitin (Ubi) gene from *Zea mays* (Toki et al 1992) followed by 500 bp of coding sequence of the LpOs06g0607800 gene from L. *Perenne* in an inverted repeat interrupted by intron 2 of the RGA2 gene from *Triticum turgidum* subsp. *durum* (Douchkov et al 2005). The hairpin cassette was terminated with the 3' untranslated region (UTR) comprising the transcriptional terminator and polyadenylation site of the nopaline synthase gene (nos) from *A. tumefaciens* pTi15955 (Fraley et al 1983).

The selection cassette (delivered either in cis or trans) comprised of the promoter, 5' untranslated region and intron from the Actin (Act1) gene from *Oryza sativa* (McElroy et al 1990) followed by a synthetic, version of hph gene from *E. coli* (Kaster et al 1983) codon-optimized for expression in monocots, which encodes a protein that confers resistance to the antibiotic hygromycin. This cassette was terminated with the 3' UTR comprising the transcriptional terminator and polyadenylation sites from the 35s gene of cauliflower mosaic virus (CaMV) (Chenault and Melcher 1993).

The selection cassette was synthesized by a commercial gene synthesis vendor (GeneArt, Life Technologies) and cloned into a Gateway-enabled vector. The LpOs06g0607800 expression cassette was synthesized by a commercial gene synthesis vendor (GeneArt, Life Technologies) with flanking attB sites. For delivery in cis the LpOs06g0607800 expression cassette was sub-cloned into pDONR221 II (Invitrogen, Life Technologies) in a BP Clonase reaction. The resulting ENTRY clone was used in a LR Clonase II (Invitrogen, Life Technologies) reaction with the Gateway-enabled vector encoding the hph expression cassette. Colonies of all assembled plasmids were initially screened by restriction digestion of miniprep DNA. Restriction endonucleases were obtained from New England Bio-Labs (NEB; Ipswich, Mass.) and Promega (Promega Corporation, WI). Plasmid preparations were performed using the QIAprep Spin Miniprep Kit (Qiagen, Hilden) or the Pure Yield Plasmid Maxiprep System (Promega Corporation, WI) following the instructions of the suppliers. Plasmid DNA of selected clones was sequenced using ABI Sanger Sequencing and Big Dye Terminator v3.1 cycle sequencing protocol (Applied Biosystems, Life Technologies). Sequence data were assembled and analyzed using the SEQUENCHER™ software (Gene Codes Corporation, Ann Arbor, Mich.).

An ideogram of the gene expression cassette is shown in FIG. 4. The full sequence of the expression cassette is shown in FIG. 75.

Example 5—Biolistic Transformation of Perennial Ryegrass (*Lolium perenne*) for Expression of dsRNA Products of the LpOs06g0607800 26S Proteasome Gene for RNAi-Mediated Down-Regulation of SI Biolistic co-transformation of perennial ryegrass with the vectors containing the LpOs06g0607800 26S Proteasome gene sequence, driving the expression of the RNAi cassette and the synthetic version of hph gene from *E. coli* for hygromycin resistance was conducted on embryogenic calli for perennial ryegrass.

The vector used along with the transformation protocol has previously been used successfully in plant transformation experiments (Bilang, et al., 1991; Spangenberg, et al., 1995a; Spangenberg, et al., 1995b; Ye, et al., 1997; Bai, et al., 2001). The perennial ryegrass biolistic transformation method is outlined in FIG. 80.

Phenotypic evaluation of the resulting transgenic plants was performed by growing the plants to maturity, then following a vernalisation period of at 5° C. with 12 hour lighting for ten weeks, the plants were subjected to 22° C. with 24 hour lighting. The change in temperature and perceived day length initiated flowering in the plants, which then occurred 2-3 weeks later. Before the ryegrass flowers opened the flowering spike was checked for morphological alterations or deformities and was then contained within a paper bag to isolate the flowers from other potential pollen donors. The flowering spike may be maintained in its isolated state until flowering is complete, at which time seed set may be assessed. Multiple spikes may be bagged per plant and each spikelet and flower assessed visually for seed production.

Once a putative transgenic plant had regenerated on the selective medium, the plant was split into three single plant tillers. Each tiller was individually screened for the presence of the transgene through conventional PCR. Oligonucleotide primers had been designed to the promoter region that originated from the Ubiquitin (Ubi) gene from *Zea mays* as well as a second assay that targeted the RGA2 intron sequence from *Triticum turgidum* subsp, which interrupts the inverted ryegrass repeat of the target gene. These regions were chosen to minimise cross amplification from the endogenous ryegrass genome. The assays were developed and initially tested on untransformed ryegrass genomic DNA to confirm that cross amplification did not occur. Transgenic events were only selected when all three tillers returned a positive result for the presence of the transgene with both assays. If variable results were seen, the single tillers that were positive were returned to growth medium and grown further, until they could be resplit into three tillers and screened again.

FIG. 81 shows PCR evaluation of transgenic status for individual tillers from regenerated transgenic events. Each transformation event was assessed through three individual tillers split from the regenerated plant. Only examples where all three tillers gave positive confirmation of the presence of the transgene, did the event get accepted for further evaluation. The brackets with numbers 1 and 2 in the figure identify 1, a transgenic event that would be discarded as all tillers are negative for the presence of the transgene and 2, a transgenic event where all three tillers have generated a positive result for the presence of the transgene.

An average of 12 different transgenic events per construct were generated, with a range of 3-19. The plants were transferred to soil and were maintained in an appropriate containment glasshouse.

TABLE 3

Numbers of transgenic events generated for the seven candidate genes undergoing functional evaluation.

| Gene Number | Gene Name | Positive Transgenic Events Generated |
|---|---|---|
| LpOs04g0648500 | Ubiquitin-specific protease 22 | 3 |
| LpOs05g0149600 | Cullin | 15 |
| LpOs06g0607800 | 26S proteasome | 8 |
| LpOs06g0680500 | Glutamate receptor | 11 |
| LpOs06g0607900 | NoPollen Gram domain | 11 |
| LpOs05g0152900 | SIAHa | 18 |
| LpOs04g0647300 | TC116908 | 19 |

Phenotypic evaluation was performed upon the plant reaching reproductive maturity. Initially pollen grains were assessed for viability to ensure a response would be seen. A common effect on plant cells passing through a transformation and tissue culture process is reduced fertility of the resultant whole plant. The viability was confirmed through staining with fluorescein diacetate (FDA). FDA is a lipophilic compound and is membrane-permeable and non-fluorescent. Viable pollen grains will have intracellular esterase activity and will be able to perform enzymatic hydrolysis of FDA upon its entry into the cell. Once FDA has been hydrolyzed within the viable pollen grain it will be a highly fluorescent compound that is unable to diffuse out of the cell and will be retained, producing an intense green fluorescence within the cytoplasm.

FIG. 82 shows FDA staining of viable pollen grains for example transgenic plants with SiRNA constructs for the down regulation of a candidate S and Z gene respectively. Both viable and non-viable pollen grains can be seen in both A and B.

Once pollen viability was confirmed pollen-pistil interactions were assessed. Dissection of the floral tissues of flowering ryegrass plants were performed to microscopically assess pollen-pistil interactions.

FIG. 83 shows stages of ryegrass flower dissection. A—Intact flowers of ryegrass. Upon reaching reproductive maturity the anthers are released from the flower. The stigmatic papillae will then extend and become visible. B—individual spikelets were excised from a floral spike for further dissection. C—Both male and female reproductive tissues were excised from the spikelet. D and E—the female tissue was further excised to examine pollen tube growth on pollinated stigmas.

Each transgenic event was represented by three plants as described in the PCR screening process. Multiple transgenic events are required as the insertion of the transgene SiRNA construct is likely to result in a range of expression levels. This difference in expression between the transgenic events is likely to lead to a range of phenotypes for the reaction. The pollen-pistil compatible/incompatible reaction can be visualised through pollen tube abortion upon contact with the stigmatic tissue, or pollen tube directed growth towards the ovary. Multiple flowers per plant are required to be assessed for confidence over the observed phenotype. Once pollinated stigmatic tissues were isolated, aniline blue staining was performed and the tissue visualised under an inverted fluorescent microscope. A range of reactions were observed. Incidences of self-incompatibility was seen for many plants, while instances of partial compatibility was also seen.

FIG. 84 shows an incompatible reaction of pollen tube growth. A and B, examples of single pollen grains germinating on stigmatic papillae and upon contact growth is arrested. The pollen tubes upon contact will often become swollen in shape through cytoplasmic pressure, indicated by arrows. C, An incompatible reaction of self pollination from a transgenic plant containing the SiRNA construct for LpOs05g0149600.

FIG. 85 shows a compatible pollen tube growth with untransformed plants. Pollen was taken from unrelated ryegrass plants and placed upon an untransformed flower. The pollen tube has made contact with the stigmatic papillae and has then continued to grow in a directed manner towards the ovary. The pollen tube upon growth will deposit callose plugs at regular intervals (indicated by arrows) to retain cytoplasmic pressure, allowing the sperm cells to successfully migrate towards the ovary. These vacated regions will become vacuolated.

FIG. 86 shows a compatible pollen reaction. The pollen tube has made contact with the stigmatic papillae and has then continued to grow in a directed manner towards the ovary. The compatible pollen tube will deposit callose plugs at regular intervals (indicated by arrows). The reaction was observed on self-pollination of a transgenic plant containing the siRNA construct for the LpOs06g0680500.

FIG. 87 shows microscopic images of the pollen-stigma interaction of two different plants containing the siRNA construct for the LpOs05g0152900 gene. The two different transgenic events (A and B) show a range of phenotypes from incompatible to partially compatible.

Example 6—Expression Analysis of the LpOs06g0607800 26S Proteasome Gene

A single genotype of perennial ryegrass was subjected to transcriptome analysis through deep-sequencing of cDNA samples derived from multiple distinct tissue types. A total of 19 different RNA samples were generated from vegetative tissues, including leaf, pseudostem and root samples for both terrestrial and subterranean aspects of gene expression (Table 4). In addition a collection of reproductive libraries were generated from anthers, pistils, stigmas and pollinated pistils. The libraries were prepared for Illumina-based sequencing using the RNASeq preparation method. Each library was internally bar-coded to permit discrimination following the sequencing process.

A total of c. 0.6 billion sequencing reads were generated from the Illumina HiSeq2000 platform. Approximately 30 million sequence reads was generated from each tissue sample. The generated sequences were then filtered and quality trimmed to ensure <3 bases per sequence read were called as "N" and mean and local Phred quality was >30 in all instances.

The quality filtered reads were then BLASTn analysed against the coding sequences of the *Brachypodium distachion* genome. The number of BLASTn matches per gene were counted per tissue type and tabulated. As the number of reads generated per sample varied, the BLASTn mapped read count was normailsed on the $75^{th}$ percentile to generate normalised values for comparative analysis. The *Brachypodium distachion* genome was used as a whole genome reference in this analysis to mitigate issues of gene absence or incomplete assemblies of any de novo generated gene catalogue.

TABLE 4

Gene expression analysis through RNA sequencing from different tissues of *Lolium perenne* L.

| Tissue name - library | Description of tissue source | Number of unique reads aligned to the *Brachypodium* CDS gene catalogue |
|---|---|---|
| Tip 1 | Tip of the youngest leaf from a single tiller | 22,752,873 |
| Tip 2 | Tip of the second youngest leaf from a single tiller | 18,298,951 |
| Tip 3 | Tip of the third youngest leaf from a single tiller | 14,929,714 |
| Mid 1 | Mid section of the youngest leaf from a single tiller | 17,729,494 |
| Mid 2 | Mid section of the second youngest leaf from a single tiller | 18,952,545 |
| Mid 3 | Mid section of the third youngest leaf from a single tiller | 13,934,280 |
| Pseudo 1 | Complete pseudostem from a single tiller | 9,887,218 |
| Pseudo 2 | Lower portion of the pseudostem of a single tiller | 12,245,297 |
| Pseudo 3 | Upper portion of the pseudostem of a single tiller | 12,594,959 |
| Root Mid | Mid section of root mass | 12,571,148 |
| Root Tip | Tip section of root mass | 12,239,578 |
| Flower | Complete flower, (un)opened | 9,920,235 |
| Pollinated Pistil 5 mins | Self pollen added to pistil, then after 5 minutes pistil excised and frozen | 10,840,818 |
| Pollinated Pistil 1 hour minus | Self pollen added to pistil, then after c. 1 hour pistil excised and frozen | 9,281,790 |
| Pollinated Pistil 1 hour plus | Self pollen already added to pistil, upon tissue harvest, for an undefined time greater than 1 hour prior to pistil being excised and frozen | 11,208,524 |
| Stigma pollinated 0 mins | Harvested following pollination at 0 minutes | 9,724,120 |

TABLE 4-continued

Gene expression analysis through RNA sequencing from different tissues of Lolium perenne L.

| Tissue name - library | Description of tissue source | Number of unique reads aligned to the Brachypodium CDS gene catalogue |
|---|---|---|
| Stigma pollinated 5 mins | Harvested following pollination at 5 minutes | 13,258,777 |
| Pistil | Complete pistil, without pollen | 13,714,389 |
| Anther | Complete anther without(out) pollen grains | 13,724,305 |

Figure 104:
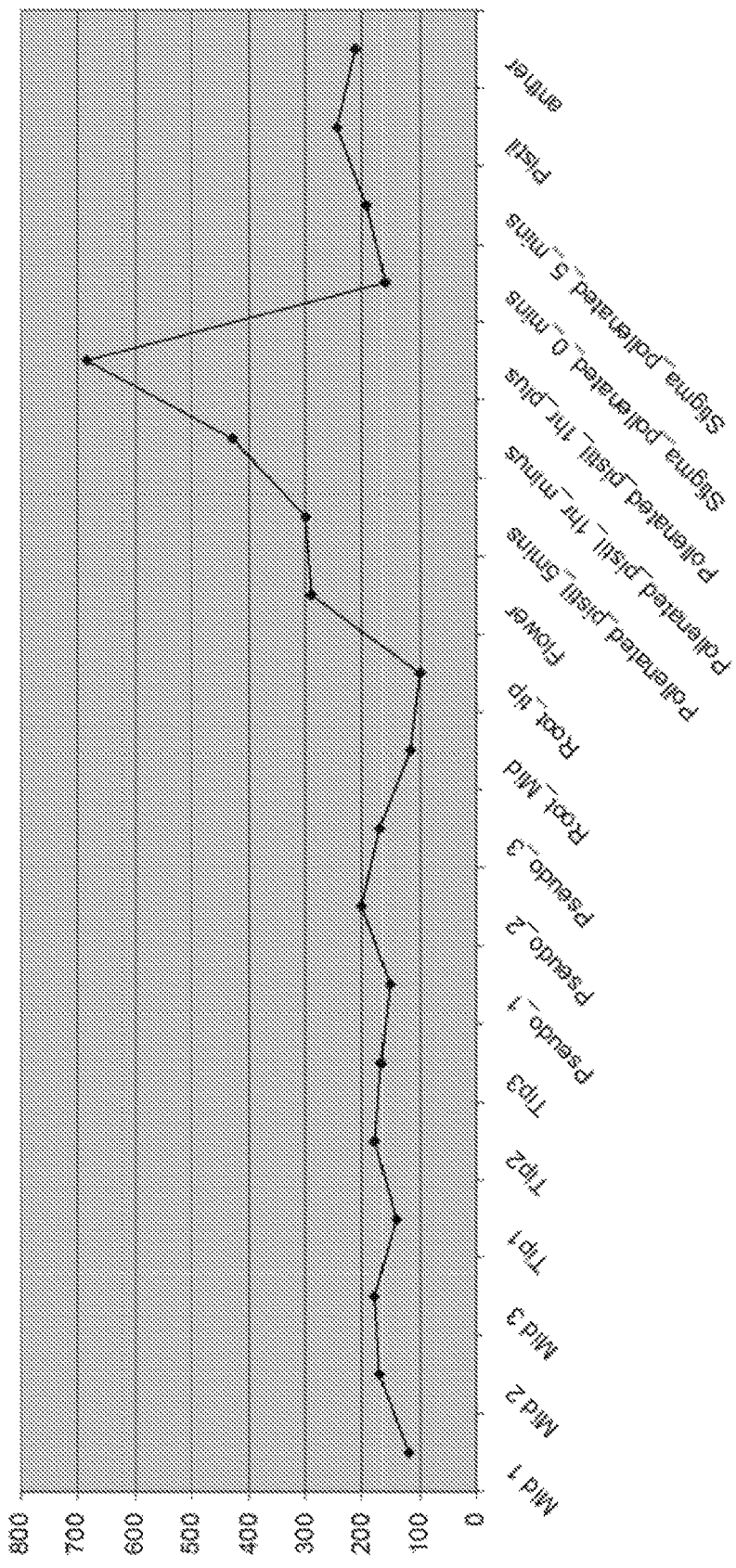
Figure 105:
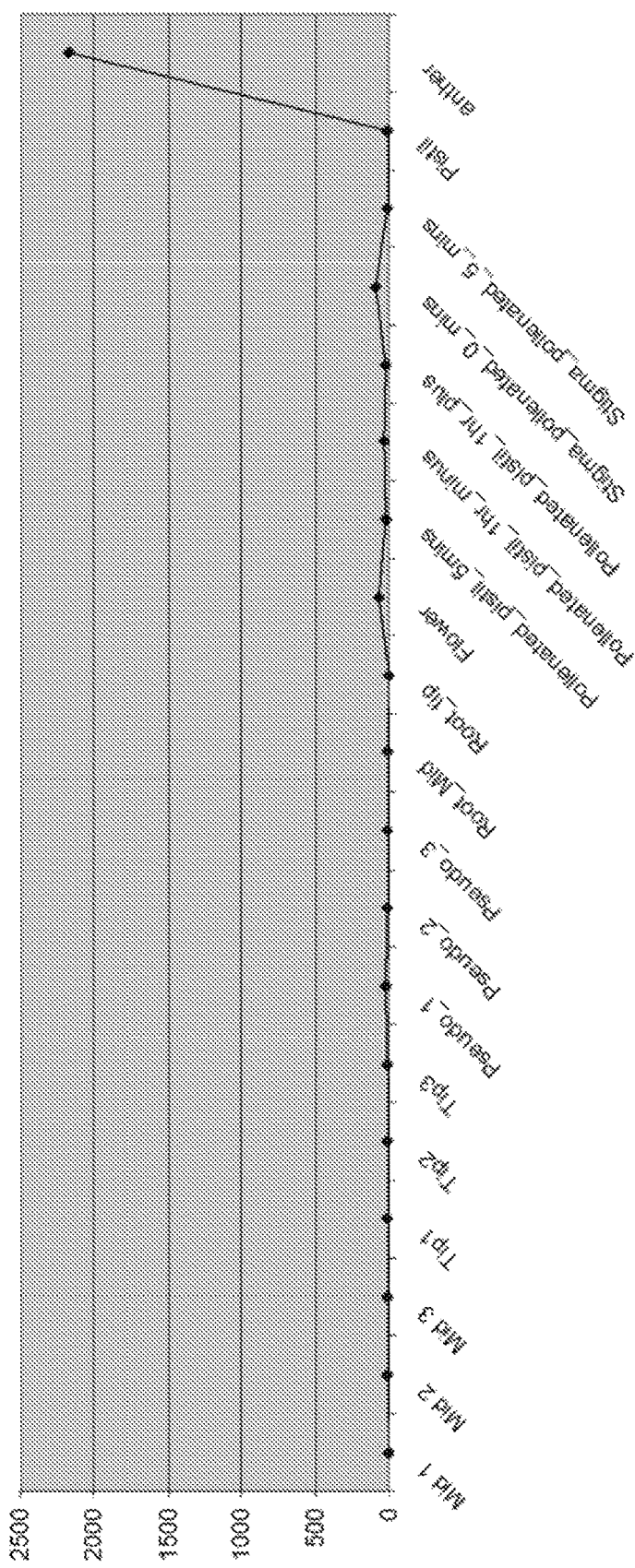
Figure 106:
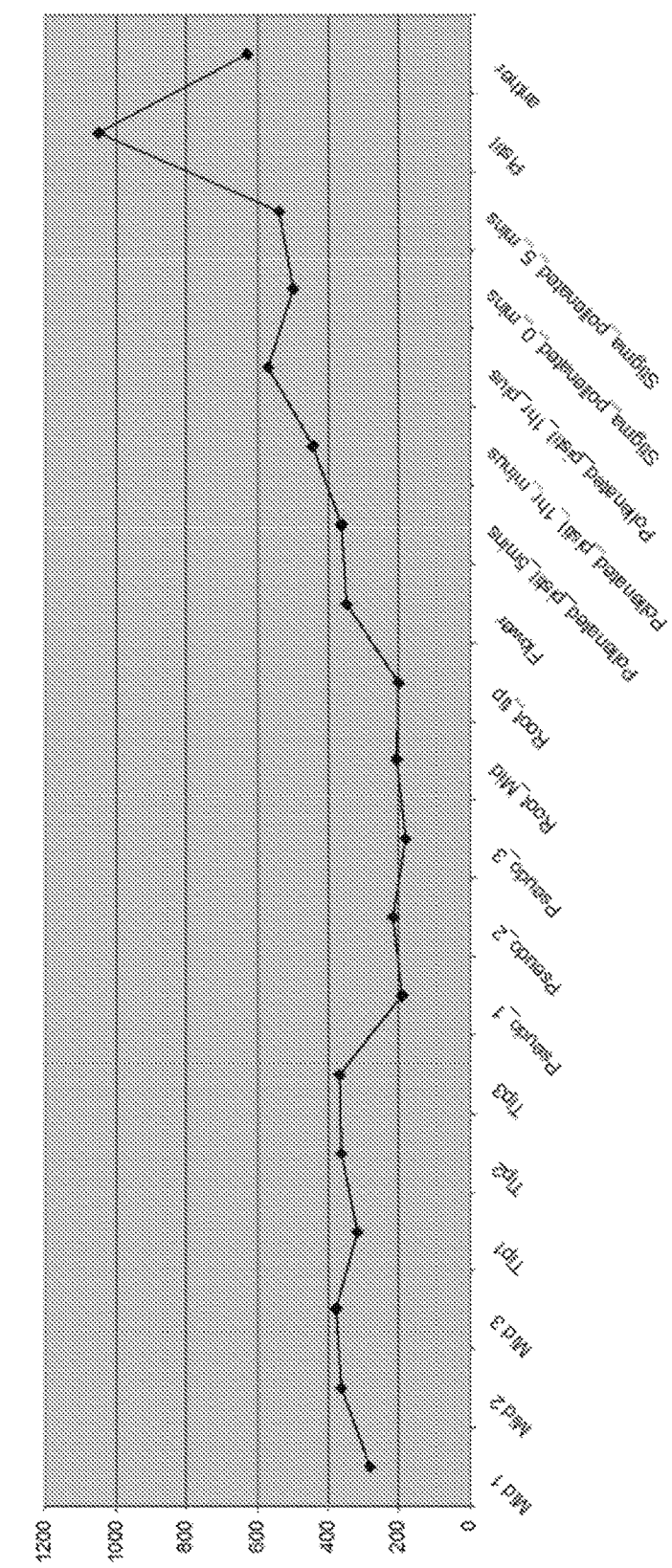
Figure 107:
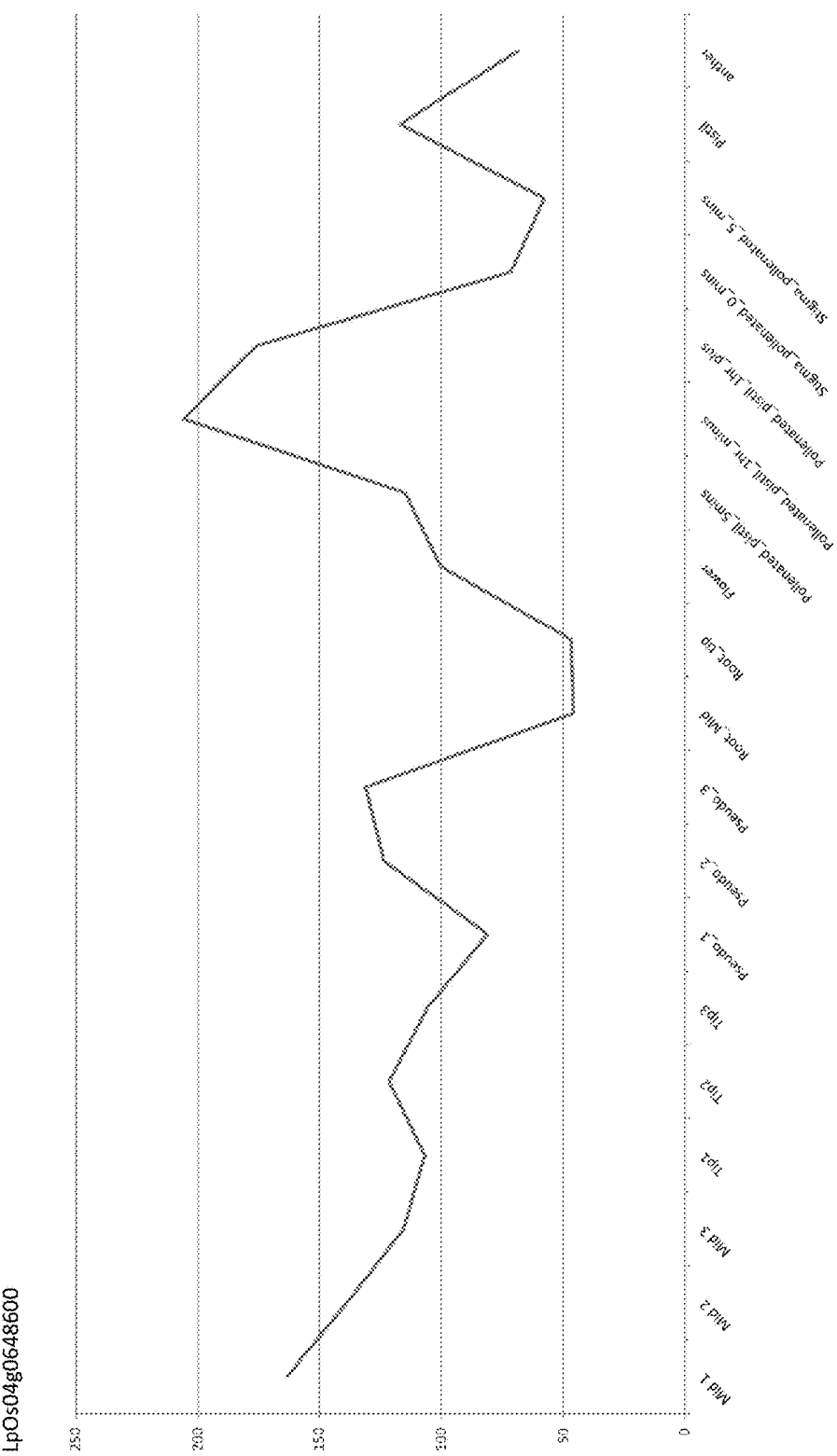
Figure 108:
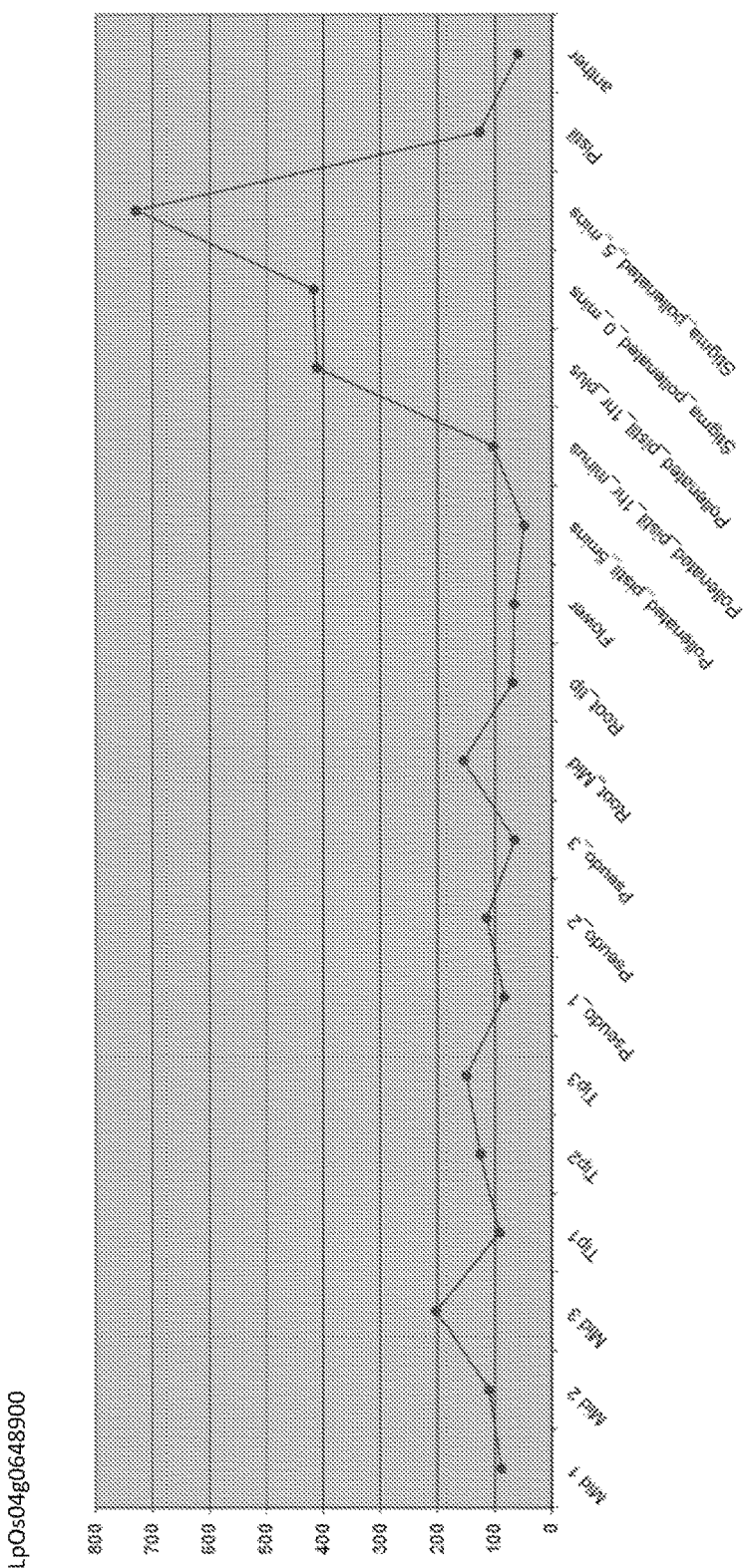

The nucleic acid sequence identified as the LpOs06g0607800 gene, when compared against the coding portion of the *Brachypodium distachion* genome sequence, identifies Bradi1g36400 as the closest matching gene sequence. The expression profile that has been generated from this analysis identifies a dramatic increase in gene expression over time in the pistil tissues upon self pollination (FIG. 104). A constant level of gene expression is detected across the entire plant, however some interference in the analysis from other gene family members is possible. Alternatively, the generic expression of the gene may have an alternative function across all tissues, or may demonstrate non-tissue specific gene expression as a result of particular promoter elements.

Example 7—Isolation of SI Genes: Cloning of the Ryegrass LpOs05g0149600 Cullin Gene Using the methods outlined in Example 3, a novel *Lolium perenne* L. gene was identified from BAC clone-related sequence that displayed sequence similarity with the rice gene Os05g0149600, hence the ryegrass gene was designated LpOs05g0149600 (SEQ ID NO: 20 and FIG. 5). The ryegrass gene was annotated as a Cullin gene through BLASTx analysis (SEQ ID NO: 90).

In addition the ryegrass Cullin gene identified in the S locus region through BAC sequencing, was compared through BLAST analysis to the genomic Impact04 sequence through BLAST analysis. The identification of the sequence from the BAC clones as well as the genomic sequence enabled the identification of variant sequence bases from the coding region of the gene (FIG. 21).

Cullins are molecular scaffolds responsible for assembling RING-based E3 ubiquitin ligases. Within the Solanaceae, Rosaceae and Plantaginaceae families the SI mechanism involves the formation of a complex consisting of a Cullin gene, an F-box gene along with a suppressor of kinetochore protein. The complex possesses the ubiquitin E3 ligase activity that attaches polyubiquitin chains to target proteins, such that ubiquitinated proteins are degraded by the 26S proteasome. The Cullin gene within the complex plays a role in assembling the other sub-units, and links to a further compound that recruits ubiquitin proteins to attach to the target proteins.

Example 8—Generation of Transformation Vectors Containing an Inverted Hairpin Structure of the LpOs05g0149600 Gene The LpOs05g0149600 expression cassette consists of the promoter, 5' untranslated region and intron from the Ubiquitin (Ubi) gene from *Zea mays* (Toki et al 1992) followed by 500 bp of coding sequence of the LpOs05g0149600 gene from *L. Perenne* in an inverted repeat interrupted by intron 2 of the RGA2 gene from *Triticum turgidum* subsp. *durum* (Douchkov et al 2005). The hairpin cassette was terminated with the 3' untranslated region (UTR) comprising the transcriptional terminator and polyadenylation site of the nopaline synthase gene (nos) from *A. tumefaciens* pTi15955 (Fraley et al 1983).

The selection cassette (delivered either in cis or trans) comprised of the promoter, 5' untranslated region and intron from the Actin (Act1) gene from *Oryza sativa* (McElroy et al 1990) followed by a synthetic version of hph gene from *E. coli* (Kaster et al 1983) codon-optimized for expression in monocots, which encodes a protein that confers resistance to the antibiotic hygromycin. This cassette was terminated with the 3' UTR comprising the transcriptional terminator and polyadenylation sites from the 35s gene of cauliflower mosaic virus (CaMV) (Chenault and Melcher 1993).

The selection cassette was synthesized, delivered and sequenced as described in Example 4.

An ideogram of the gene expression cassette is shown in FIG. 6. The full sequence of the expression cassette is shown in FIG. 63.

Example 9—Biolistic Transformation of Perennial Ryegrass (*Lolium perenne*) for Expression of dsRNA Products of the LpOs05g0149600 Cullin Gene for RNAi-Mediated Down-Regulation of SI Biolistic co-transformation of perennial ryegrass with the vectors containing the LpOs05g0149600 gene sequence, driving the expression of the RNAi cassette and the synthetic version of hph gene from *E. coli* for hygromycin resistance was conducted on embryogenic calli for perennial ryegrass, as described in Example 5.

Example 10—Expression Analysis of LpOs05g0149600 Cullin Gene

Figure 92:
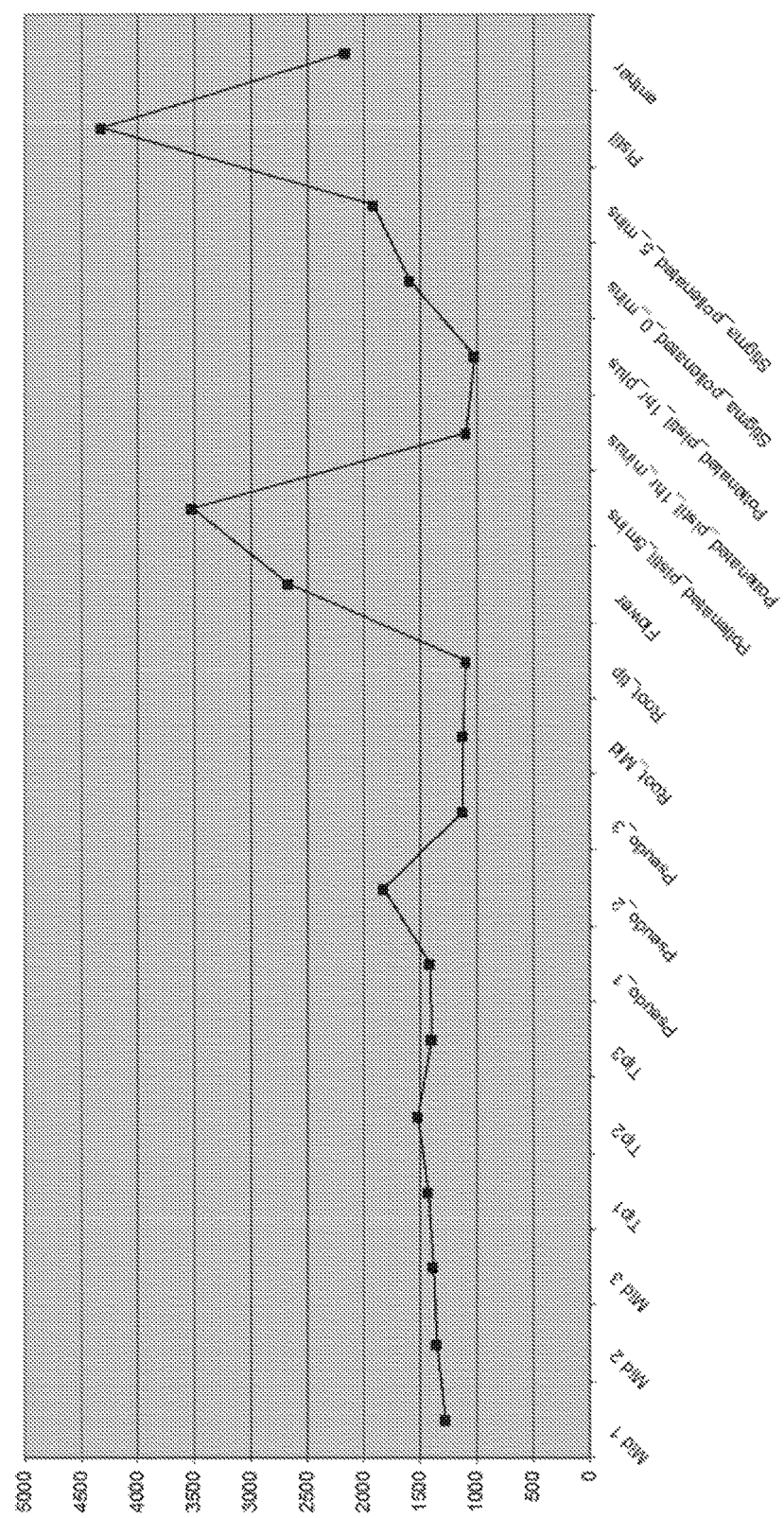
Figure 93:
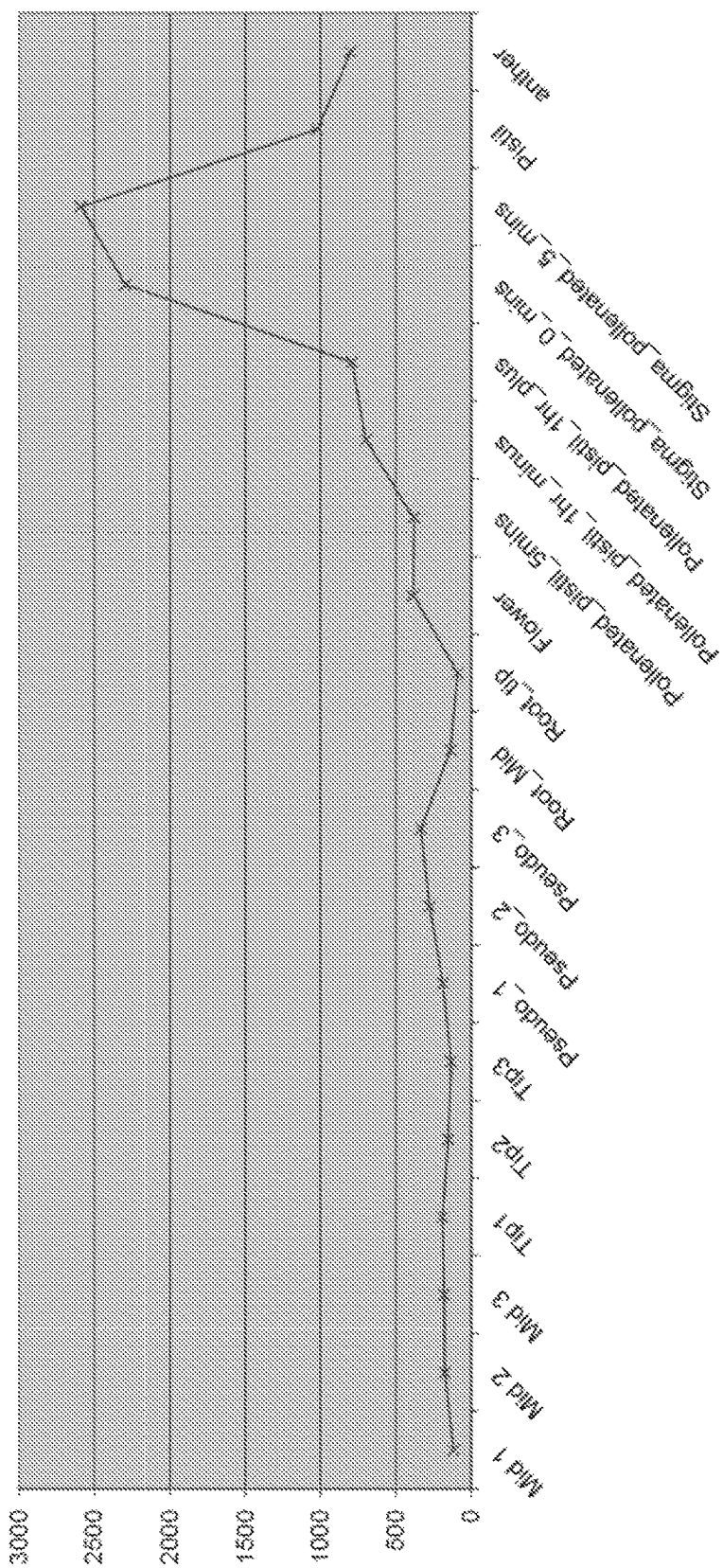
Figure 94:
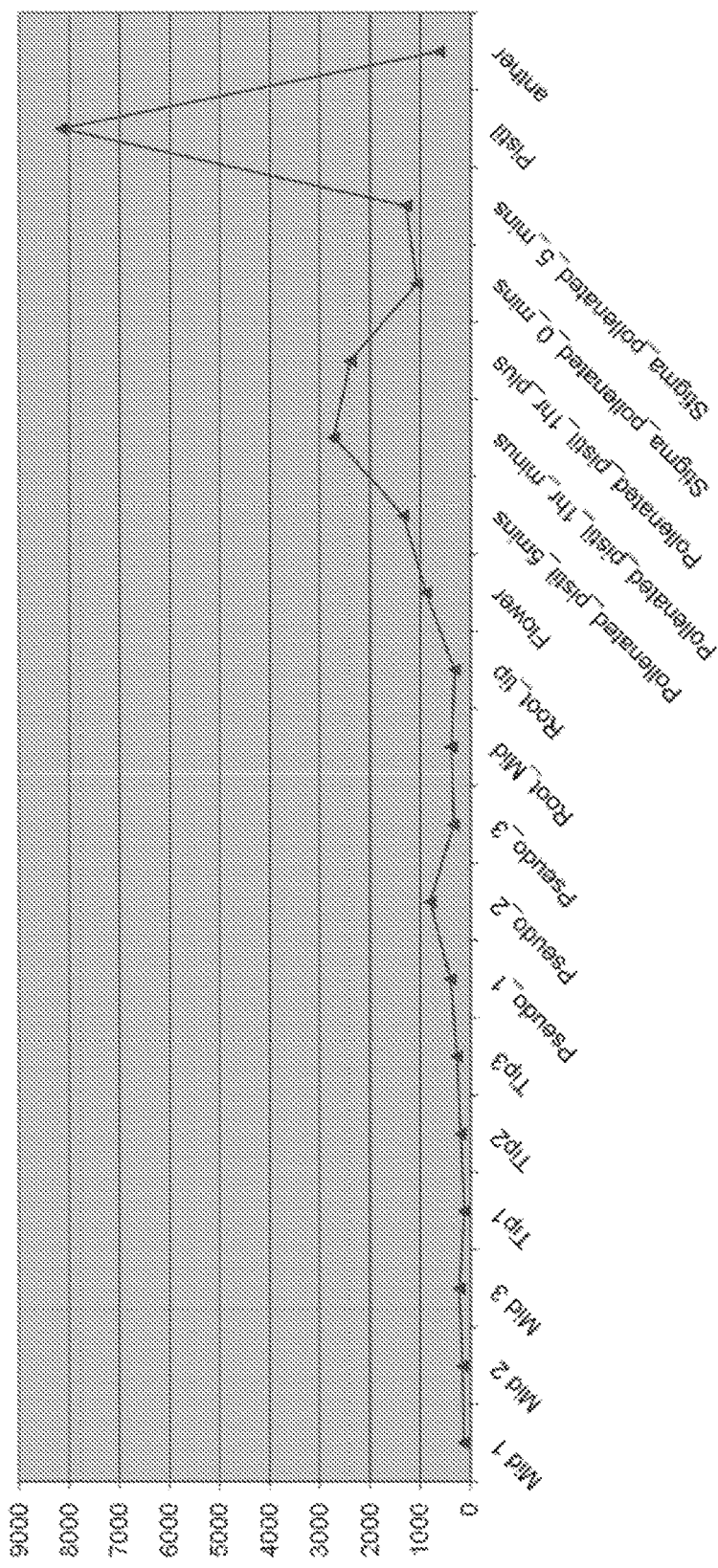
Figure 95:
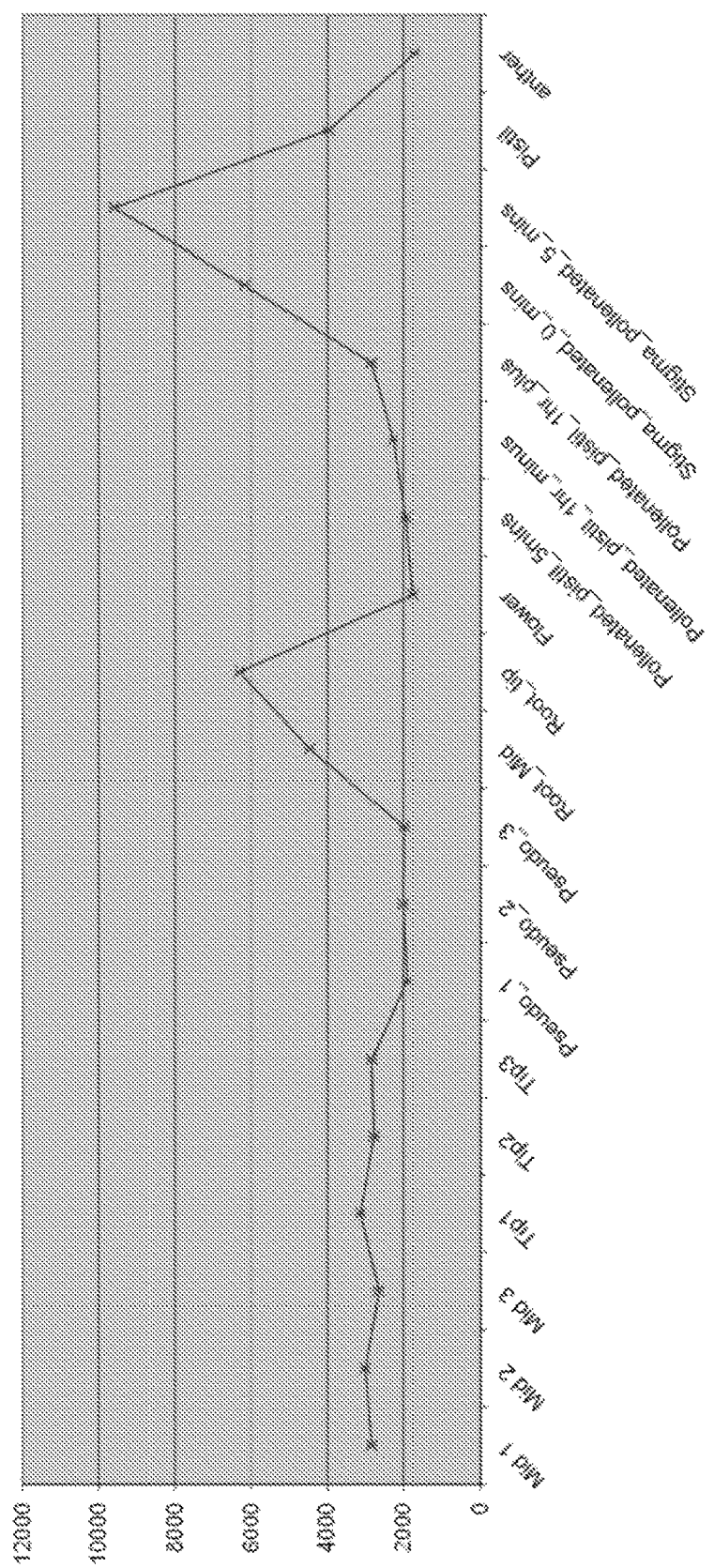
Figure 96:
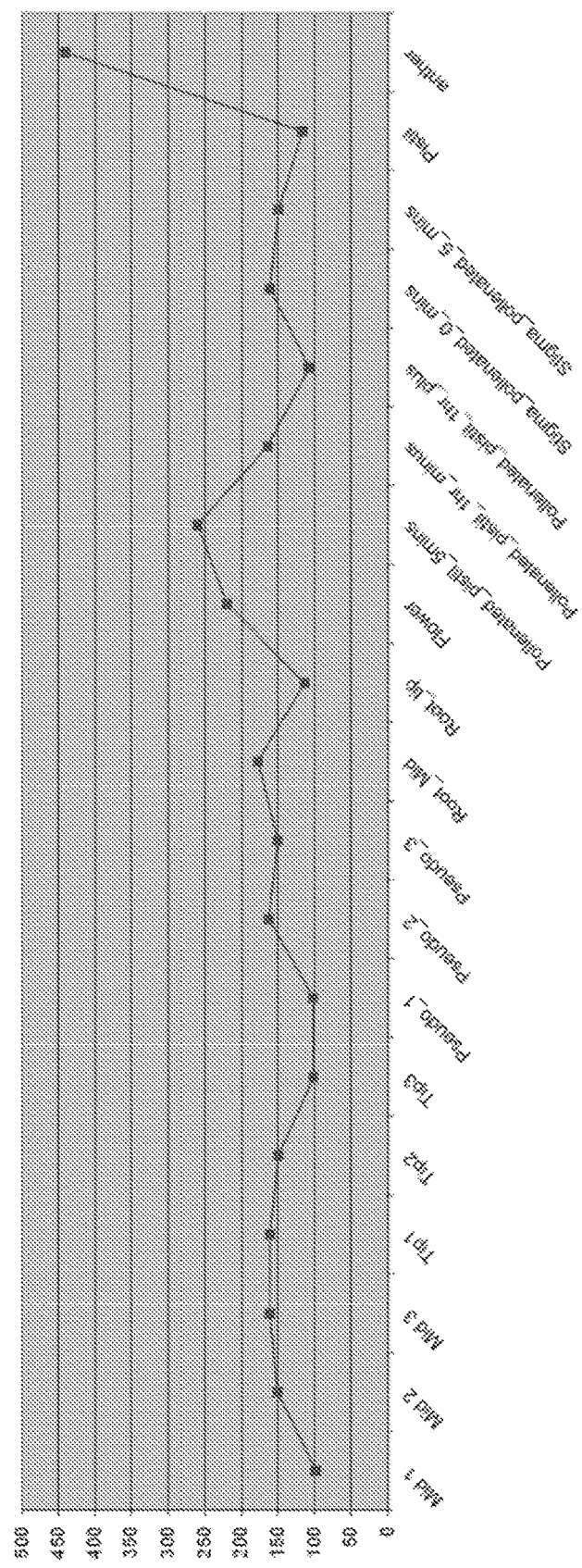

Using the methods outlined in Example 6, the nucleic acid sequence identified as the LpOs05g0149600 gene, when compared against the coding portion of the *Brachypodium distachion* genome sequence, identifies Bradi2g35830 as the closest matching gene sequence. The expression profile that has been generated from this analysis identifies a constitutive level of gene expression in all tissues (FIG. 92). However, significantly elevated levels of gene expression are seen in pistil and pollinated pistils at 5 minutes as well as whole flower and stigma at 0 and 5 minutes. The pattern of expression seen can be described as increasing in stigma from 0 to 5 minutes along with a corresponding increase in pistil at 5 minutes that then decreases to the constitutive level at a 1 hour time point.

Example 11—Isolation of SI Genes: Cloning of the Ryegrass LpOs06g0680500 Glutamate Receptor Gene Using the methods outlined in Example 3, a novel *Lolium perenne* L. gene was identified from BAC-clone related sequence that displayed sequence similarity with the rice gene Os06g0680500, hence the ryegrass gene was designated LpOs06g0680500 (FIG. 7 and SEQ ID NO:39). The ryegrass gene was annotated as a glutamate receptor gene through a BLASTx analysis (e value=0 compared to the rice amino acid sequence) and was identified as containing the requisite GABA domain (SEQ ID NO: 109).

Glutamate receptor genes have been identified in *Arabidopsis thaliana* and tobacco as forming influx channels in tip cell types that undergo directed patterns of growth such as those of pollen tubes, as well as root hairs. Studies on *Arabidopsis* root cells show that glutamate induces a sharp depolarization of the membrane potential, and a concomitant rise in intracellular calcium. Growth of tobacco pollen tubes in the presence of a glutamate receptor antagonist has been shown to be repressed, as is also the case for specific directed uptake of calcium. Gene knock-out experiments of pollen expressing glutamate receptor genes in *Arabidopsis* have documented reduction in growth rates as well as abnormal morphology of the tip and tube.

While applicants do not wish to be restricted by theory, LpOs06g0680500 LpGlu1 Glutamate receptor gene is hence proposed to be the male determinant of the S locus.

Example 12—Generation of Transformation Vectors Containing an Inverted Hairpin Structure of the LpOs06g0680500 LpGlu1 Gene The nucleic acid sequence identified as LpOs06g0680500 gene has a 484 bp fragment selected as a design element for expression cassette. The *Zea mays* ubiquitin gene promoter (Christensen et al. 1992) was used to drive expression and the nopaline synthase (nos) gene terminator (Bevan, 1984; Rogers et al., 1985) was selected to arrest transcription.

The LpGlu1 expression cassette consists of the promoter, 5' untranslated region and intron from the Ubiquitin (Ubi) gene from *Zea mays* (Toki et al 1992) followed by 484 bp of coding sequence of the LpGlu1 gene from L. *Perenne* in an inverted repeat interrupted by intron 2 of the RGA2 gene from *Triticum turgidum* subsp. *durum* (Douchkov et al 2005). The hairpin cassette was terminated with the 3' untranslated region (UTR) comprising the transcriptional terminator and polyadenylation site of the nopaline synthase gene (nos) from *A. tumefaciens* pTi15955 (Fraley et al 1983).

The selection cassette (delivered either in cis or trans) comprised of the promoter, 5' untranslated region and intron from the Actin (Act1) gene from *Oryza sativa* (McElroy et al 1990) followed by a synthetic, version of hph gene from *E. coli* (Kaster et al 1983) codon-optimized for expression in monocots, which encodes a protein that confers resistance to the antibiotic hygromycin. This cassette was terminated with the 3' UTR comprising the transcriptional terminator and polyadenylation sites from the 35s gene of cauliflower mosaic virus (CaMV) (Chenault and Melcher 1993).

The selection cassette was synthesized, delivered and sequenced as described in Example 4.

An ideogram of the gene expression cassette is shown in FIG. 8. The full sequence of the expression cassette is shown in FIG. 68.

Example 13—Biolistic Transformation of Perennial Ryegrass (*Lolium perenne*) for Expression of dsRNA Products of the LpOs06g0680500 Glutamate Receptor Gene for RNAi-Mediated Down-Regulation of SI Biolistic co-transformation of perennial ryegrass with the vectors containing the LpOs06g0680500 LpGlu1 gene sequence, driving the expression of the RNAi cassette and the synthetic version of hph gene from *E. coli* for hygromycin resistance was conducted on embryogenic calli for perennial ryegrass, as described in Example 5.

Figure 97:
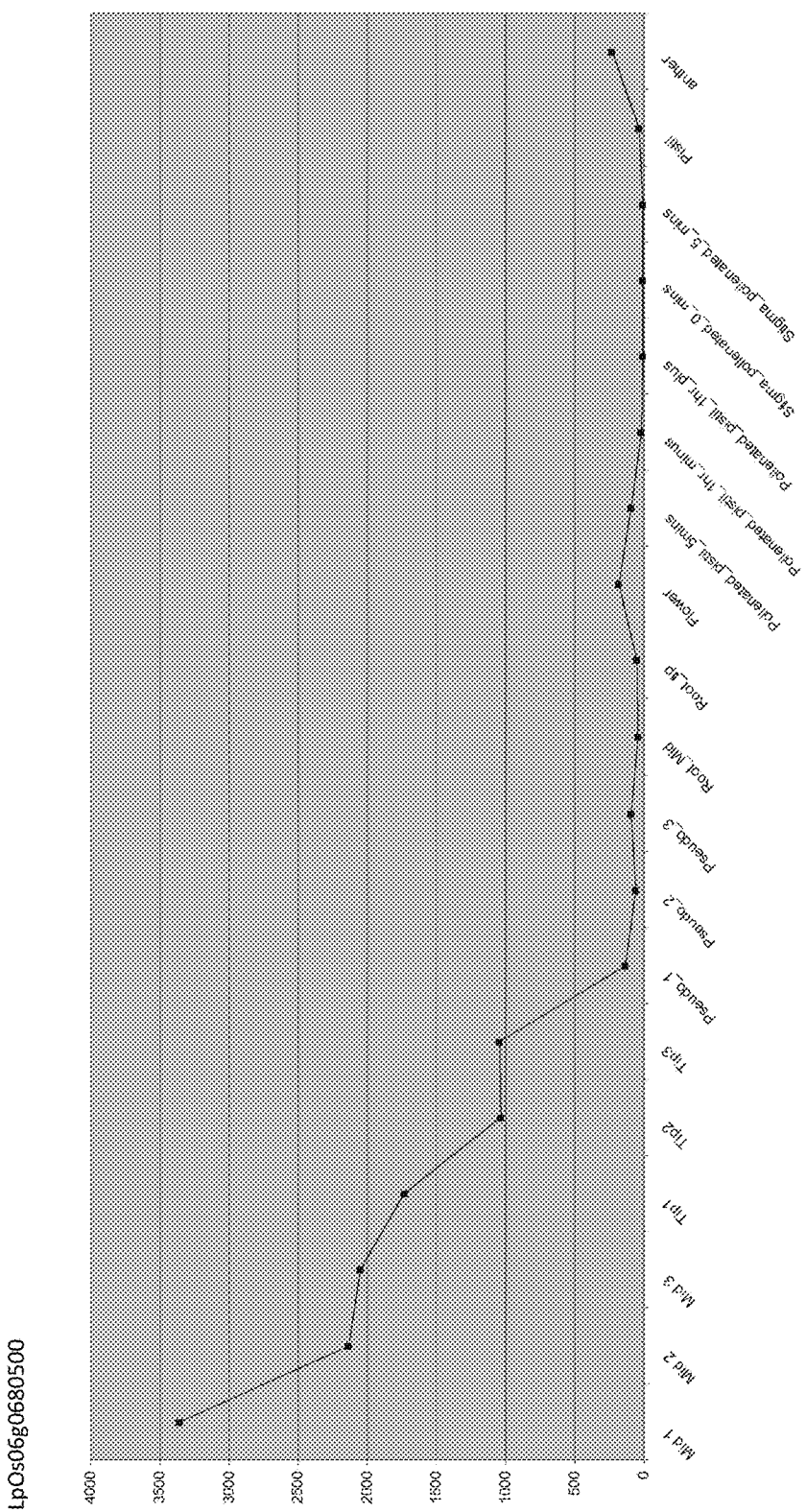
Figure 98:
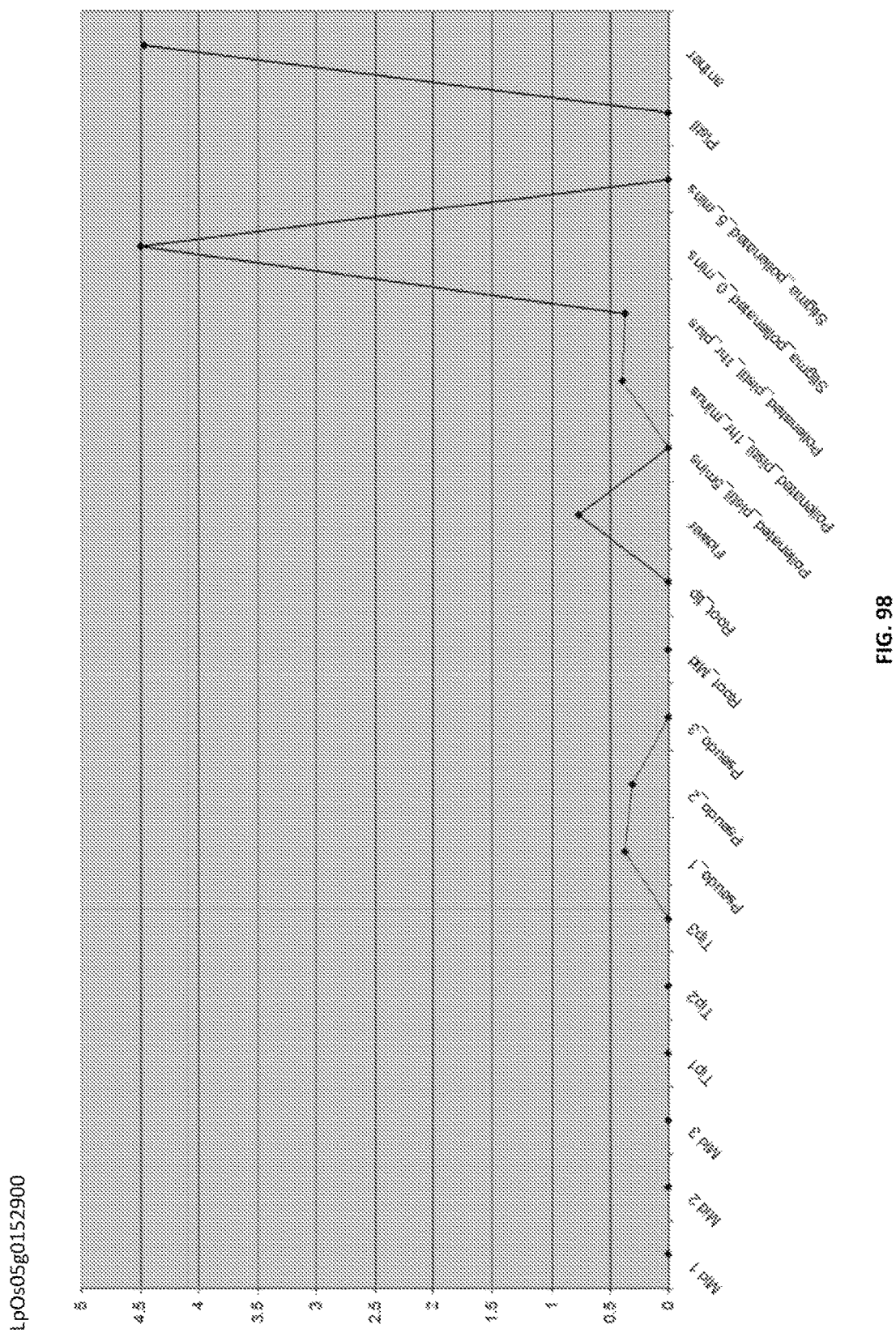
Figure 99:
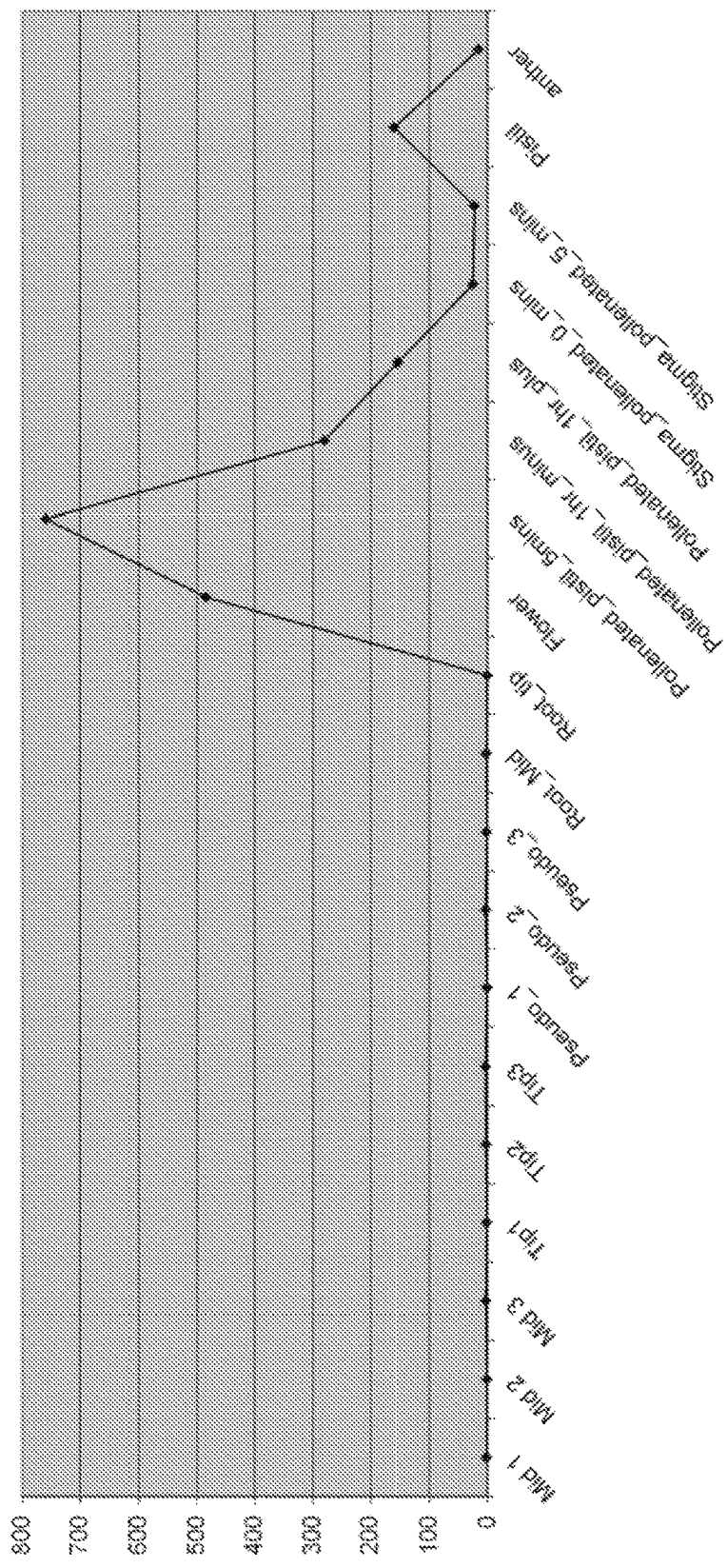
Figure 100:
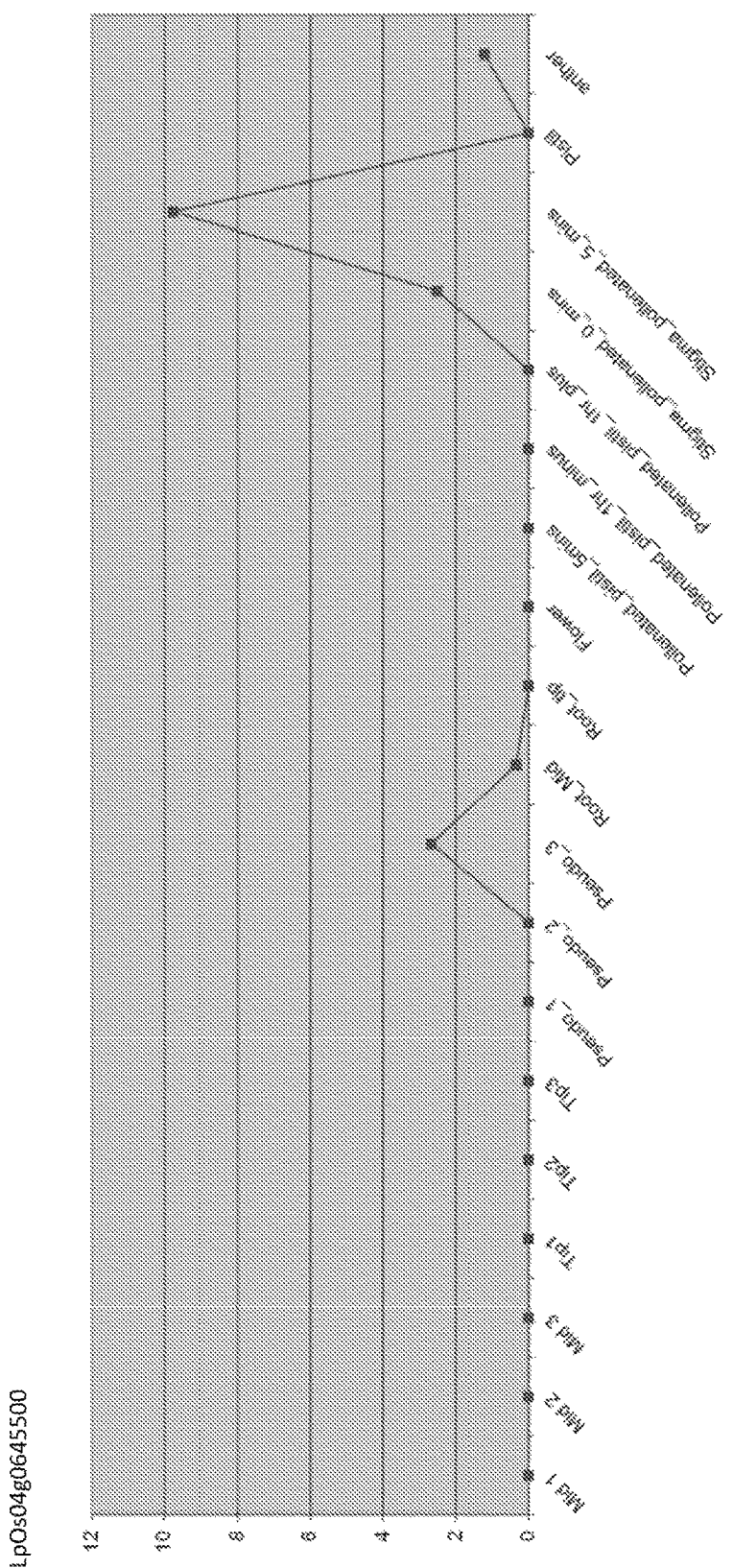
Figure 101:
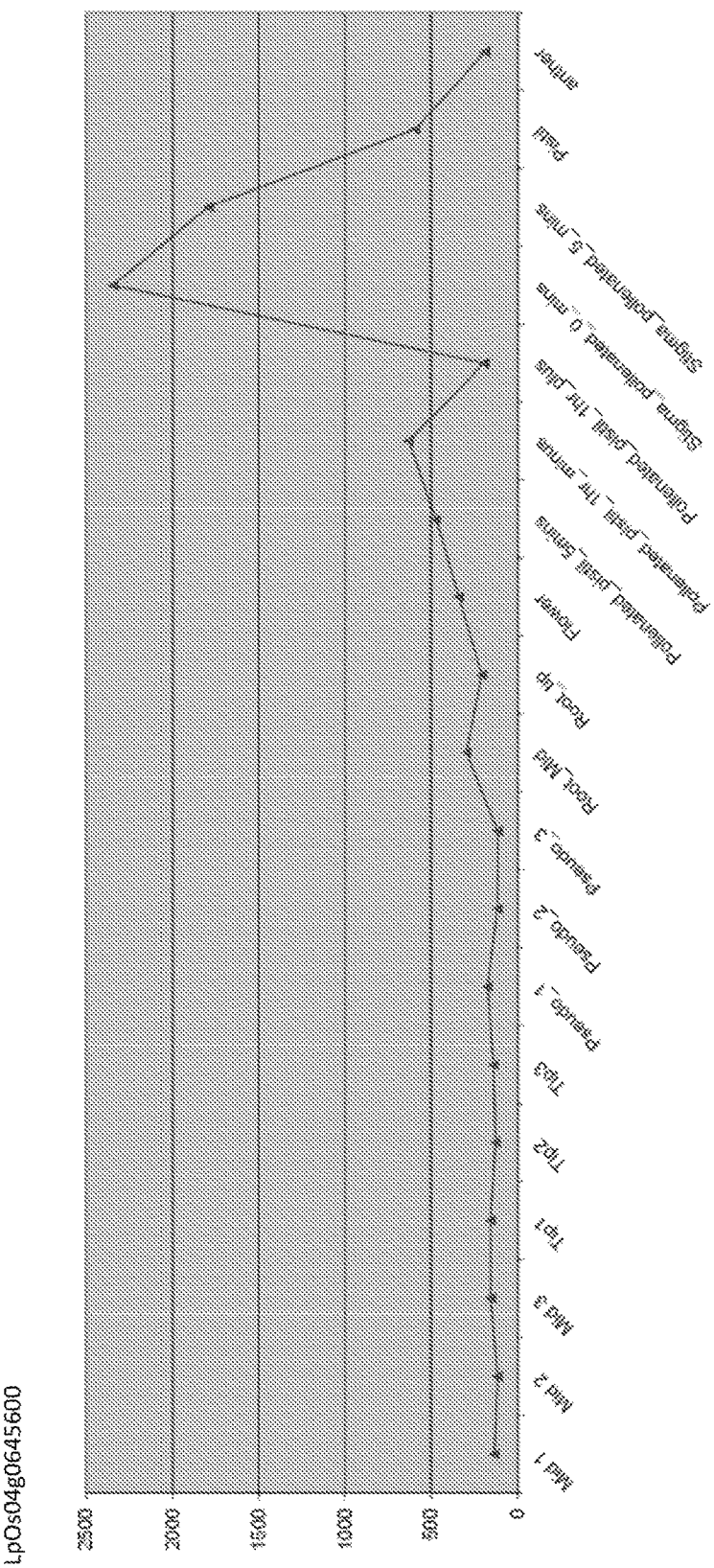

Example 14—Expression Analysis of the LpOs06g0680500 Glutamate Receptor Gene Using the methods outlined in Example 6, the nucleic acid sequence identified as the LpOs06g0680500 gene, when compared against the coding portion of the *Brachypodium distachion* genome sequence, identifies Bradi1g32800 as the closest matching gene sequence. The expression profile that has been generated from this analysis identifies high levels of gene expression in vegetative tissues and some gene expression in anthers (FIG. 97). The glutamate genes represent a gene family within the *Brachypodium distachion* genome that will be involved in many functions across the different plant tissues and consequently mapping of related sequences or alternative functions for glutamate genes is likely and could explain the constitutive expression. Nevertheless, a significant increase in expression is detected in anthers and not in the female pistil or stigma tissues.

Example 15—Isolation of SI Genes: Cloning of the Ryegrass LpOs04g0648500 Gene Using the methods outlined in Example 3, a novel *Lolium perenne* L. gene was identified from BAC clone-related sequence that displayed sequence similarity with the rice gene Os04g0648500, hence the ryegrass gene was designated LpOs04g0648500 (See FIG. 9 and SEQ ID NO: 62). The perennial ryegrass gene was identified as physically linked to the TC116908-related gene. The TC116908-derived genetic marker co-segregated with the Z locus in rye (*Secale cereale* L.) (Hackauf and Wehling 2005). In the perennial ryegrass BAC clone including the TC116908 orthologue, LpOs04g0648500 and other 2 genes were identified (Shinozuka et al. 2010).

The LpOs04g0648500 gene was annotated as an Ubiquitin-specific protease 22 gene through a BLASTx analysis (SEQ ID NO: 132). The gene contained a Znf-UBP and BRAP2 domains. The Znf-UBP domain exhibits the ubiquitin-specific protease activity and functions as protein stabiliser through target-specific de-ubiquitinylation. The human BRAP2 domain was originally identified as interacting with the BRCA1 (breast cancer 1) gene products. A sequence homology search indicated that this domain is also conserved in the *Arabidopsis* At2g26000 [zinc finger (ubiquitin-hydrolase) domain-containing protein] and At2g42160 [zinc finger (C3HC4-type RING finger) family protein] gene products, suggesting that this gene is involved in the ubiquitin-proteasome system.

In the S-RNase-based and Brassicaceae-type SI systems, involvement of the ubiquitin-proteasome system has been suggested. The 26S proteasome complex is bound with a UBP, and the 19S regulatory particle of the 26S proteasome complex is activated by the UBP. In the Z locus-linked BAC clones, 26S proteasome-related genes (LpTC116908 and LpOs06g0607800) were identified, of which products may interact with the LpOs04g0648500 gene product.

While applicants do not wish to be restricted by theory, the LpOs04g0648500 Ubiquitin-specific protease 22 gene is hence proposed to be one of the SI determinants in the Z locus

Example 16—Generation of Transformation Vectors Containing an Inverted Hairpin Structure of the LpOs04g0648500 Gene The nucleic acid sequence identified as LpOs04g0648500 gene has a 578 bp fragment selected as a design element for expression cassette. The *Zea mays* ubiquitin gene promoter (Christensen et al. 1992) was used to drive expression and the nopaline synthase (nos) gene terminator with (Bevan, 1984; Rogers et al., 1985) was selected to arrest transcription.

The LpOs04g0648500 expression cassette consists of the promoter, 5' untranslated region and intron from the Ubiquitin (Ubi) gene from *Zea mays* (Toki et al 1992) followed by 578 bp of coding sequence of the LpOs04g0648500 gene from L. *Perenne* in an inverted repeat interrupted by intron 2 of the RGA2 gene from *Triticum turgidum* subsp. *durum* (Douchkov et al 2005). The hairpin cassette was terminated with the 3' untranslated region (UTR) comprising the transcriptional terminator and polyadenylation site of the nopaline synthase gene (nos) from *A. tumefaciens* pTi15955 (Fraley et al 1983).

The selection cassette (delivered either in cis or trans) comprised of the promoter, 5' untranslated region and intron from the Actin (Act1) gene from *Oryza sativa* (McElroy et al 1990) followed by a synthetic, version of hph gene from *E. coli* (Kaster et al 1983) codon-optimized for expression in monocots, which encodes a protein that confers resistance to the antibiotic hygromycin. This cassette was terminated with the 3' UTR comprising the transcriptional terminator and polyadenylation sites from the 35s gene of cauliflower mosaic virus (CaMV) (Chenault and Melcher 1993).

The selection cassette was synthesized, delivered and sequenced as described in Example 4.

An ideogram of the gene expression cassette is shown in FIG. 10. The full sequence of the expression cassette is shown in FIG. 77.

Example 17—Biolistic Transformation of Perennial Ryegrass (*Lolium perenne*) for Expression of dsRNA Products of the LpOs04g0648500 Gene for RNAi-Mediated Down-Regulation of SI Biolistic co-transformation of perennial ryegrass with the vectors containing the LpOs04g0648500 gene sequence, driving the expression of the RNAi cassette and the synthetic version of hph gene from *E. coli* for hygromycin resistance was conducted on embryogenic calli for perennial ryegrass, as described in Example 5.

Example 18—Expression Analysis of the LpOs04g0648500 Gene

Using the methods outlined in Example 6, the nucleic acid sequence identified as the LpOs04g0648500 gene, when compared against the coding portion of the *Brachypodium distachion* genome sequence, identifies Bradi5g23970 as the closest matching gene sequence. The expression profile that has been generated from this analysis identifies a low level of constitutive expression in all tissues, with an increase in all of the reproductive samples. The highest level of gene expression was detected in the pistil samples (See FIG. 106).

Example 19—Isolation of SI Genes: Cloning of the Ryegrass LpOs06g0607900 Gene Using the methods outlined in Example 3, a novel *Lolium perenne* L. gene was identified from BAC clone-related sequence that displayed sequence similarity with the rice gene Os06g0607900, and the ryegrass gene was hence designated LpOs06g0607900 (See FIG. 11 and SEQ ID NO: 59). The gene contained both the C2 and GRAM amino acid domains (SEQ ID NO: 129). The C2 domain is comprised of 2 highly conserved domains that are separated by a basic region. The C2 domain is a calcium-dependent membrane-targeting module that is found in proteins involved in signal transduction or membrane trafficking. The domain is often involved in calcium-dependent phospholipid binding and in membrane targeting processes. The GRAM domain is a glucosyltransferase, Rab-like GTPase activators and myotubularin domain. The domain is associated with membrane-coupled processes and signal transduction. The GRAM domain was first computationally identified in 2000 (Doerks et al.) and functional analysis of the domain has since elucidated roles in protein association with a target membrane.

The rice homologue of the novel gene identified from the BAC sequence characterisation has been partially described in its function and has been designated the "no-pollen" gene (Osnop). The rice Osnop gene was identified and characterised through a Ds transposon insertion strategy. The deleted gene displayed abnormal anthers and no pollen production. Through promoter fusions with the GUS reporter gene, the endogenous gene was characterised as showing gene expression late in pollen formation and in the germination of pollen tubes (Jiang et al. 2005).

While applicants do not wish to be restricted by theory, the LpOs06g0607900 No-Pollen (LpNOP) gene is hence proposed to be the male determinant of the Z locus.

Example 20—Generation of Transformation Vectors Containing an Inverted Hairpin Structure of the LpOs06g0607900 LpNOP1 Gene The LpOs06g0607900 expression cassette consists of the promoter, 5' untranslated region and intron from the Ubiquitin (Ubi) gene from *Zea mays* (Toki et al 1992) followed by 400 bp of coding sequence of the LpOs06g0607900 gene from L. *Perenne* in an inverted repeat interrupted by intron 2 of the RGA2 gene from *Triticum turgidum* subsp. *durum* (Douchkov et al 2005). The hairpin cassette was terminated with the 3' untranslated region (UTR) comprising the transcriptional terminator and polyadenylation site of the nopaline synthase gene (nos) from *A. tumefaciens* pTi15955 (Fraley et al 1983).

The selection cassette (delivered either in cis or trans) comprised of the promoter, 5' untranslated region and intron from the Actin (Act1) gene from *Oryza sativa* (McElroy et al 1990) followed by a synthetic, version of hph gene from *E. coli* (Kaster et al 1983) codon-optimized for expression in monocots, which encodes a protein that confers resistance to the antibiotic hygromycin. This cassette was terminated with the 3' UTR comprising the transcriptional terminator and polyadenylation sites from the 35s gene of cauliflower mosaic virus (CaMV) (Chenault and Melcher 1993).

The selection cassette was synthesized, delivered and sequenced as described in Example 4.

An ideogram of the gene expression cassette is shown in FIG. 12. The full sequence of the expression cassette is shown in FIG. 76.

Example 21—Biolistic Transformation of Perennial Ryegrass (*Lolium perenne*) for Expression of dsRNA Products of the LpOs06g0607900 Gene for RNAi-Mediated Down-Regulation of SI Biolistic co-transformation of perennial ryegrass with the vectors containing the LpOs06g0607900 gene sequence, driving the expression of the RNAi cassette and the synthetic version of hph gene from *E. coli* for hygromycin resistance was conducted on embryogenic calli for perennial ryegrass, as described in Example 5.

Example 22—Expression Analysis of the LpOs06g0607900 Gene

Using the methods outlined in Example 6, the nucleic acid sequence identified as the LpOs06g0607900 gene, when compared against the coding portion of the *Brachypodium distachion* genome sequence, identifies Bradi1g36390 as the closest matching gene sequence. The expression profile that has been generated from this analysis identifies high levels of gene expression almost exclusively in anthers. Limited expression has been detected in flowers and stigma pollinated at 0 minutes, which could result from anthers in the flower or initial germination of the pollen grain (See FIG. 105).

Example 23—Isolation of SI Genes: Cloning of the Ryegrass LpOs05g0152900 a Seven-in-Absentia Homologue Gene Using the methods outlined in Example 3, from the exome sequencing of the genotype Impact04, a *Lolium perenne* L. gene was identified that displayed sequence similarity with the rice gene Os05g0152900 (FIG. 13 and SEQ ID NO: 40). Due to sequence similarity with seven in absentia homologue (SIAH) genes, the identified gene was designated LpSIAH (SEQ ID NO: 110).

SIAH proteins consist of a RING finger domain at the N-terminus and a Sina domain at the C-terminus, and have an ubiquitin-E3 ligase activity when a homodimer is formed (Den Herder et al. 2008). Suppression of SIAH protein function in plant species results in increased root systems, enlarged leaves and increased shoot number, suggesting that SIAH protein is involved in a wide range of plant developmental processes.

Substrates of SIAH proteins are degraded in an ubiquitin-related pathway following interaction. Glutamate receptor proteins are substrates of SIAH proteins. The RING finger domain of SIAH protein and the Siah-interacting domain of glutamate receptor proteins are essential for interaction. Interaction of the SIAH and glutamate receptor proteins exerts effects on calcium current modulation. A glutamate receptor-like gene, LpGlu1, was identified as being located physically close to LpSIAH.

Example 24—Generation of Transformation Vectors Containing an Inverted Hairpin Structure of the LpOs05g0152900 LpSIAH Gene The LpSIAH expression cassette consists of the promoter, 5' untranslated region and intron from the Ubiquitin (Ubi) gene from *Zea mays* (Toki et al 1992) followed by 400 bp of coding sequence of the LpSIAH gene from *L. Perenne* in an inverted repeat interrupted by intron 2 of the RGA2 gene from *Triticum turgidum* subsp. *durum* (Douchkov et al 2005). The hairpin cassette was terminated with the 3' untranslated region (UTR) comprising the transcriptional terminator and polyadenylation site of the nopaline synthase gene (nos) from *A. tumefaciens* pTi15955 (Fraley et al 1983).

The selection cassette (delivered either in cis or trans) comprised of the promoter, 5' untranslated region and intron from the Actin (Act1) gene from *Oryza sativa* (McElroy et al 1990) followed by a synthetic, version of hph gene from *E. coli* (Kaster et al 1983) codon-optimized for expression in monocots, which encodes a protein that confers resistance to the antibiotic hygromycin. This cassette was terminated with the 3' UTR comprising the transcriptional terminator and polyadenylation sites from the 35s gene of cauliflower mosaic virus (CaMV) (Chenault and Melcher 1993).

The selection cassette was synthesized, delivered and sequenced as described in Example 4.

An ideogram of the gene expression cassette is shown in FIG. 14. The full sequence of the expression cassette is shown in FIG. 69.

Example 25—Biolistic Transformation of Perennial Ryegrass (*Lolium perenne*) for Expression of dsRNA Products of the LpOs05g0152900 LpSIAH Gene for RNAi-Mediated Down-Regulation of SI Biolistic co-transformation of perennial ryegrass with the vectors containing the LpOs05g0152900 LpSIAH gene sequence, driving the expression of the RNAi cassette and the synthetic version of hph gene from *E. coli* for hygromycin resistance was conducted on embryogenic calli for perennial ryegrass, as described in Example 5.

Example 26—Expression Analysis of the LpOs05g0152900 LpSIAH Gene

Using the methods outlined in Example 6, the nucleic acid sequence identified as the LpOs05g0152900 gene, when compared against the coding portion of the *Brachypodium distachion* genome sequence, identifies Bradi2g35550 as the closest matching gene sequence. The expression profile that has been generated from this analysis identifies gene expression predominantly in anthers and the pollinated stigma at 0 minutes. Low or negligible expression in all other tissues was observed (See FIG. 98).

Example 27—Isolation of SI Genes: Cloning of the Ryegrass LpTC116908 Gene

Using the methods outlined in Example 3, a novel *Lolium perenne* L. gene was identified from BAC clone-related sequence that displayed sequence similarity with the rice gene Os04g0647300 and the barley gene TC116908, hence the ryegrass gene was designated LpTC116908. In rye (*Secale cereale* L.), a TC116908 derived genetic marker co-segregated with the rye Z locus. Close to the TC116908 derived marker, 4 genetic markers were located (Hackauf and Wehling 2005). The corresponding genetic markers were assigned to the lower part of LG2 of perennial ryegrass (Shinozuka et al. 2010). BAC clones containing the genetic marker-related sequences were sequenced to identify *Lolium perenne* L. genes encoded in the Z locus (See FIG. 15 and SEQ ID NO: 54).

The LpTC116908 gene was annotated as an Ubiquitin-specific protease 22 gene through a BLASTx analysis (SEQ ID NO: 124). The gene contained a Znf-UBP (Zinc finger ubiquitin-specific processing protease) and peptidase C19 domains. The Znf-UBP domain exhibits the ubiquitin-specific protease activity and functions as protein stabiliser through target-specific de-ubiquitinylation. The peptidase C19 domain shares sequence similarity to the Znf-UBP-like domain and possesses ubiquitin-specific peptidase activity. The LpTC116908 gene was expressed in perennial ryegrass reproduction organs (Shinozuka et al. 2010).

In the S-RNase-based and Brassicaceae-type SI systems, involvement of the ubiquitin-proteasome system has been suggested. The 26S proteasome complex is bound with a UBP, and the 19S regulatory particle of the 26S proteasome complex is activated by the UBP. In the Z locus-linked BAC clones, 26S proteasome-related genes (LpOs06g0607800 and LpOs04g0648800) were identified, of which products may interact with the LpTC116908 gene product.

While applicants do not wish to be restricted by theory, the LpTC116908 Ubiquitin-specific protease 22 gene is hence proposed to be one of SI determinants of the Z locus.

Example 28—Generation of Transformation Vectors Containing an Inverted Hairpin Structure of the LpTC116908 LpOs04g0647300 Gene The LpTC116908 expression cassette consists of the promoter, 5' untranslated region and intron from the Ubiquitin (Ubi) gene from *Zea mays* (Toki et al 1992) followed by 492 bp of coding sequence of the LpTC116908 gene from *L. Perenne* in an inverted repeat interrupted by intron 2 of the RGA2 gene from *Triticum turgidum* subsp. *durum* (Douchkov et al 2005). The hairpin cassette was terminated with the 3' untranslated region (UTR) comprising the transcriptional terminator and polyadenylation site of the nopaline synthase gene (nos) from *A. tumefaciens* pTi15955 (Fraley et al 1983).

The selection cassette (delivered either in cis or trans) comprised of the promoter, 5' untranslated region and intron from the Actin (Act1) gene from *Oryza sativa* (McElroy et al 1990) followed by a synthetic, version of hph gene from *E. coli* (Kaster et al 1983) codon-optimized for expression in monocots, which encodes a protein that confers resistance to the antibiotic hygromycin. This cassette was terminated with the 3' UTR comprising the transcriptional terminator and polyadenylation sites from the 35s gene of cauliflower mosaic virus (CaMV) (Chenault et al 1993).

The selection cassette was synthesized, delivered and sequenced as described in Example 4.

An ideogram of the gene expression cassette is shown in FIG. 16. The full sequence of the expression cassette is shown in FIG. 73.

Example 29—Biolistic Transformation of Perennial Ryegrass (*Lolium perenne*) for Expression of dsRNA Products of the LpTC116908 Gene for RNAi-Mediated Down-Regulation of SI Biolistic co-transformation of perennial ryegrass with the vectors containing the LpTC116908 gene sequence, driving the expression of the RNAi cassette and the synthetic version of hph gene from *E. coli* for hygromycin resistance was conducted on embryogenic calli for perennial ryegrass, as described in Example 5.

Example 30—Expression Analysis of the LpTC116908 Gene

Figure 102:
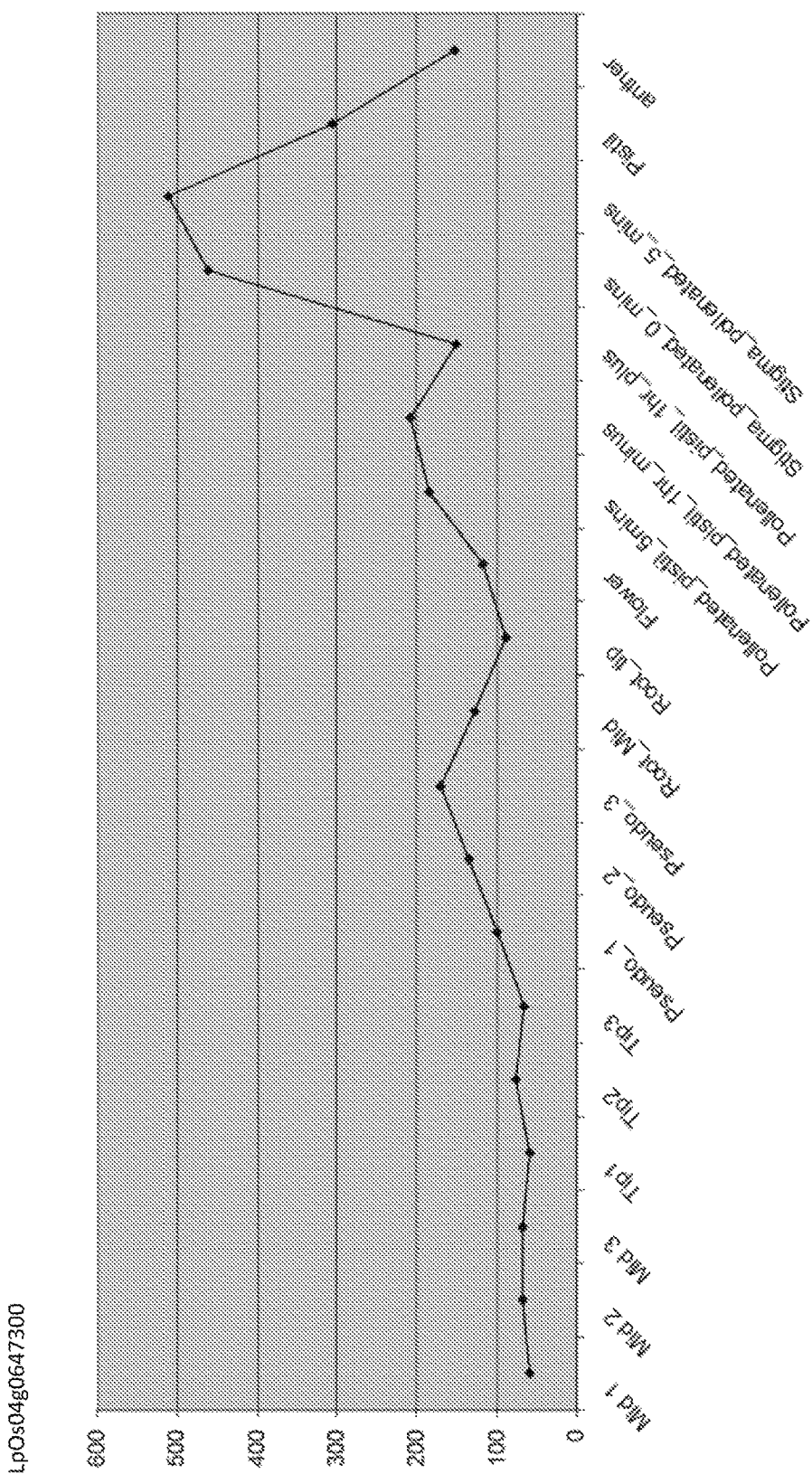
Figure 103:
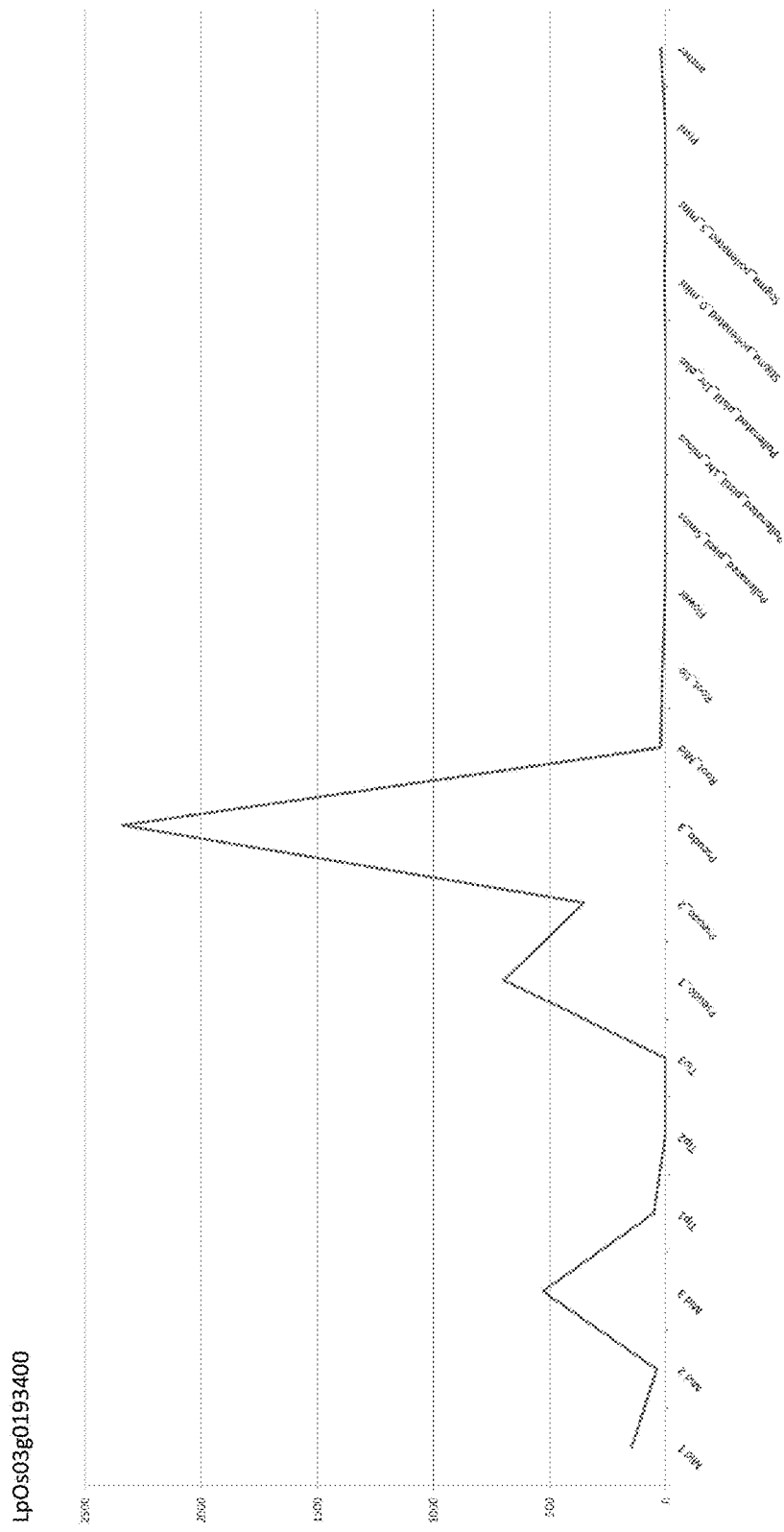

Using the methods outlined in Example 6, the nucleic acid sequence identified as the LpTC116908 gene, when compared against the coding portion of the *Brachypodium distachion* genome sequence, identifies Bradi5g23920 as the closest matching gene sequence. The expression profile that has been generated from this analysis identifies a low level of constitutive expression in all tissues, with a significant increase in both of the pollinated stigma samples. Slight increases in gene expression are also identified in pistil samples as well as pseudostems (FIG. 102).

Example 31. Generation of Transformation Vectors Containing an Inverted Hairpin Structure SiRNA constructs were prepared for all 21 candidate genes, using the methods outlined in Example 4. From the resequencing data the most conserved 300-500 bp region of the gene was chosen for the design.
S Locus
LpOs05g0148600
LpOs01g0369700
LpOs05g0149100
LpOs05g0149500
LpOs05g0149600
LpOs05g0150400
LpOs05g0150500
LpOs05g0151300
LpOs05g0152400
LpOs06g0680500
LpOs05g0152900
LpOs05g0153200
Z Locus
LpOs04g0645500
LpOs04g0645600
LpOs04g0647300
LpOs03g0193400
LpOs06g0607800
LpOs06g0607900
LpOs04g0648500
LpOs04g0648600
LpOs04g0648900

FIGS. 59 to 79 show nucleic acid sequence of the expression cassettes used in biolistic mediated transformation of *Lolium perenne* L. Legend: Gateway attB1 site (bold underline); *Zea mays* Ubi promoter (italics)+intron (underlined italics); *Lolium perenne* coding region in antisense and sense orientations (underline); rga2 intron (bold); Nopaline synthase (nos) terminator (bold italics); Gateway attB2 site (bold underline)

Example 32. Application of Genomic Data from the S and Z Interval in F1 Hybrid Grass Breeding Heterosis or hybrid vigour is the phenomenon where the performance of an $F_1$ hybrid is greater than that of the parents. Ryegrass cultivars today are commonly bred from a limited number of elite parents (4-12), polycrossed together and then further polycrossed to bulk up seed numbers suitable for commercial sale. There are no commercial activities or schemes to capture heterosis in ryegrass breeding currently.

The identification of genetic markers in linkage disequilibrium with S and Z loci enables haplotypic prediction. The ability to genotype individuals for S and Z haplotypes opens a new avenue for efficient $F_1$ hybrid ryegrass production by selectively bottlenecking and combining haplotypes. The production of $F_1$ hybrid ryegrass by selectively bottlenecking SI alleles using linked genetic markers displays the greatest potential for cost effective application to commercial ryegrass breeding in the near future. The application of SI genetic markers to bottleneck SI allows breeders to work with any germplasm at their disposal with no prior requirements. The haplotype defining SI markers will enable breeders to selectively bottleneck SI haplotypes (without selfing) within defined pools to reduce the within pool compatibility and then bring two pools together for random crossing, where the SI haplotypes ensure between pool compatibility is greater than within, resulting in an increased production of $F_1$ progeny.

For example, in the initial stages a breeding nursery of phenotypically elite plants would be genotyped with the SI linked molecular markers and haplotypic prediction would be performed. Pairs of individuals (termed parent pools) would then be identified where one individual is heterozygous at both S and Z and the other individual is homozygous at one locus, either S or Z, and heterozygous at the other locus (for the same haplotypes present in the heterozygous individual), for example:
Ind x s1s2-z1z2
Ind y s1s2-z1z1

Two parent pools where the S and Z haplotypes between pools are completely different are identified and taken forward to the next step. The two selected pools are referred to as pool A and B in the follow stages.

Following from the initial parental pool development the seeds are multiplied. During this seed bulk stage, pool A and B are maintained in isolation to ensure no foreign SI haplotypes are introduced through pollen flow or external seed.

One round of random mating within each pool will bring the S and Z haplotype frequencies to equilibrium, with 50% of individuals heterozygous at both the S and Z loci, 25% homozygous at S or Z for one of the haplotypes, and the remaining 25% of individuals homozygous at the same locus but for the opposing haplotype, for example:
25% inds—s1s1-z1z2
50% inds—s1 s2-z1z2
25% inds—s2s2-z1z2

Continued unselected random mating within the two pools will maintain the homozygous and heterozygous frequencies whilst increasing seed numbers. In every round of mating, the heterozygous locus will alternate, for example:

| 25% - s1s1-z1z2 | 25% - s1s2-z1z1 | 25% - s1s1-z1z2 |
| 50% - s1s2-z1z2 → | 50% - s1s2-z1z2 → | 50% - s1s2-z1z2 |
| 25% - s2s2-z1z2 | 25% - s1s2-z2z2 | 25% - s2s2-z1z2 |

Pollen within pools will never be compatible with individuals heterozygous at both the S and Z loci. Consequently those individuals (which make up 50% of the plants) will only be pollen donors, not producing any seed, resulting in a 50% seed production rate within pools.

Once sufficient seed has been generated within pools, equal numbers of seed would be combined and sown out for $F_1$ seed production. As pollen from within pools is not compatible with the respective S and Z heterozygous individuals, only pollen from between the two pools will fertilize those individuals, resulting in those plants yielding 100% $F_1$ hybrid seed. The remaining individuals, which are compatible with pollen both from within and between pools will yield both $F_1$ hybrid and within-pool seed. However, as there is a greater number of compatible haplotypic combinations from between-pools, than from within-pools, a higher proportion of the seed will be $F_1$ hybrids.

From simulation of all the haplotypic combinations between and within-pools, and the proportion of compatible combinations, the theoretical percentage of $F_1$ hybrid seed produced following the described scheme is >83%. With hybrid individuals likely to be more vigorous and competitive than within-pool seed, the proportion of hybrids, >83%, is likely to increase on farm when grown under a competitive sward situation. In the proposed breeding design, pool A and B will reach haplotype frequency equilibrium after one round of crossing, meaning that breeders can bulk seed up within pools over as many generations as deemed necessary, as long as the pools are maintained in isolation from foreign pollen. This also allows breeders to perform small test crosses between pools with each seed bulk up to ensure heterosis still remains in the progeny. At no point during the breeding design is there a requirement for controlled pollination.

This breeding design could be applied to any outbreeding grass species belonging to the Poaceae that has the S and Z loci regulating self-incompatibility without limitation. More preferably the grass species would be of the Bambusoideae, Ehrhartoideae (formerly Oryzoideae) or Pooideae Glade. More preferably the grass species would be of the tribe Poeae. More preferably the grass species would be of the genera *Lolium, Festuca, Poa, Dactylis, Bromus, Secale, Pennisetum* and *Panicum*. More preferably the grass species would be of the genera *Lolium* and *Festuca*. More preferably the species would be of the genus *Lolium*. More preferably the *Lolium* species would be *Lolium perenne* (perennial ryegrass), *Lolium multiflorum* (Italian ryegrass), *Lolium boucheanum* (hybrid ryegrass) *Lolium arundinaceum* (tall fescue) and *Lolium pratense* (meadow fescue).

FIG. 109 shows a schematic diagram of F1 hybrid grass breeding. Plants are initially genotyped using markers on or around the S and Z loci. Two parental pools are then generated and multiplied, with testing of the degree of heterosis between pools once sufficient seed has been generated.

REFERENCES

Bai, Y., et al. (2001) Genetic transformation of elite turf-type cultivars of Tall Fescue. *International Turfgrass Society Research Journal*, 9: 129-136.

Bevan, M. (1984) Binary *Agrobacterium* vectors for plant transformation. *Nucleic Acids Res.* 12: 8711-8721.

Bilang, R., et al. (1991) The 3'-terminal region of the hygromycin-B-resistance gene is important for its activity in *Escherichia coli* and *Nicotiana tabacum*. *Gene*, 100: 247-250.

Chenault K D and Melcher U (1993) Cauliflower mosaic virus isolate CMV-1. *Plant Physiology* 1993 101 (4), 1395-1396

Christensen, et al. (1992) Maize polyubiquitin genes: structure, thermal perturbation of expression and transcript splicing, and promoter activity following transfer to protoplasts by electroporation. *Plant Mol Biol* 18: 675-689

Cogan, N O I, Shinozuka, H., Sawbridge, T I, Spangenberg, G C., Forster, J W. (2012a) Whole genome sequencing of perennial ryegrass (*Lolium perenne* L.) supports exome assembly for gene and SNP catalogue development. Molecular Breeding of Forage and Turf 2012, Salt Lake City, Utah, USA, P-28.

Cogan, N O I, Shinozuka, H, Sawbridge, T I, Spangenberg, G C, Forster, J W. (2012b) Development of a transcriptome atlas for perennial ryegrass (*Lolium perenne* L.). Molecular Breeding of Forage and Turf 2012, Salt Lake City, Utah, USA, P-25.

Den Herder G, De Keyser A, De Rycke R, Rombauts S, Van de Velde W, Clemente M R, Verplancke C, Mergaert P, Kondorosi E, Holsters M, Goormachtig S: Seven in absentia proteins affect plant growth and nodulation in Medicago truncatula. *Plant Physiol* 2008, 148(1):369-382.

Doerks, T., Strauss, M., Brendel, M. and Bork, P. (2000) GRAM, a novel domain in glucosyltransferases, myotubularins and other putative membrane-associated proteins. Trends Biochem. Sci., 25, 483-485

Douchkov D, Nowara D, Zierold U, Schweizer P (2005) A High-Throughput Gene-Silencing System for the Functional Assessment of Defense-Related Genes in Barley Epidermal Cells. *Molecular Plant Microbe Interactions* 2005 18 755-76

Forster J W, Cogan N O I, Dobrowolski M P, Francki M G, Spangenberg G C, Smith K F (2008) Functionally-associated molecular genetic markers for temperate pasture plant improvement. In Henry R J (ed.) Plant genotyping II: SNP technology. CABI Press, Wallingford, Oxford, U K, pp. 154-187

Forster, J. W., Cogan, N. O. I., Shinozuka, H., Pembleton, L. W., Wang, J., Sawbridge, T. I., Hayes, B. J., Spangenberg, G. C. Next-generation solutions for genomics-assisted breeding of outbreeding forage plant species. Molecular Breeding of Forage and Turf 2012, Salt Lake City, Utah, USA, Session 9 Invited Talk.

Fraley R T, Rogers S G, Horsch R B, Sanders P R, Flick J S, Adams S P, Bittner M L, Brand L A, Fink C L, Fry J S, Galluppi G R, Goldberg S B, Hoffmann N L, Woo S C Expression of bacterial genes in plant cells (1983) Proceedings of the National Academy of Sciences U.S.A. 80 (15) 4803-4807

Hackauf B, Wehling P (2005) Approaching the self-incompatibility locus Z in rye (*Secale cereale* L.) via comparative genetics. *Theor Appl Genet* 110: 832-845

Jiang S Y, Cai M, Ramachandran S. The *Oryza sativa* no pollen (Osnop) gene plays a role in male gametophyte development and most likely encodes a C2-GRAM domain containing protein. Plant Mol Biol 2005; 57:835-853.

Kaster K R, Burgett S G, Rao R N, Ingolia T D (1983) Analysis of a bacterial hygromycin B resistance gene by transcriptional and translational fusions and by DNA sequencing. *Nucleic Acids Research* 11(19), 6895-6911

McElroy D, Zhang W, Cao J, Wu R, Isolation of an efficient actin promoter for use in rice transformation (1990) The Plant Cell 1990 2(2) 163-171

Rogers S G, O'Connell K, Horsch R B and Fraley R T (1985) In: Biotechnology in Plant Science, eds, Zaitlin, M., Day, P., Hollaender, A. and Wilson, C. A., Academic Press, Inc., New York, N.Y., pp 219-226.

Shinozuka H, Cogan N O I, Smith K F, Spangenberg G C, Forster J W. (2010) Fine-scale comparative genetic and physical mapping supports map-based cloning strategies for the self-incompatibility loci of perennial ryegrass (*Lolium perenne* L.) Plant Mol Biol 72:343-355

Spangenberg, G., et al. (1995a). Transgenic tall fescue and red fescue plants from microprojectile bombardment of embryogenic suspension cells. *J Plant Physiol.*, 145: 693-701.

Spangenberg, G., et al. (1995b). Transgenic perennial ryegrass (*Lolium perenne*) plants from microprojectile bombardment of embryogenic suspension cells. *Plant Sci.*, 108: 209-217.

Spangenberg G C, Forster J W, Edwards D, John U, Mouradov A, Emmerling M, Batley J, Felitti S, Cogan N O I, Smith K F, Dobrowolski M P (2005) Future directions in the molecular breeding of forage and turf. In: Humphreys M O (ed) Molecular breeding for the genetic improvement of forage crops and turf. Wageningen Academic Publishers, The Netherlands, pp 83-97

Toki S, Takamatsu S, Nojiri C, Ooba S, Anzai H, Iwata M, Christensen A H, Quail P H, Uchimiya H (1992) Expression of a maize ubiquitin gene promoter-bar chimeric gene in transgenic rice plants. *Plant Physiology*, 100 1503-07

Ye, X., et al. (1997) Transgenic Italian ryegrass (*Lolium multiflorum*) plants from microprojectile bombardment of embryogenic suspension cells. *Plant Cell Rep.*, 16: 379-384.

SEQUENCE LISTING (210 sequences)

SEQ ID NO: 1 - DNA, 810 bp, Lolium perenne
atgctcctcctaatccgccgcctcaccgccgttccttcccgcctagccgccctcgcactccggcaaccccacggtcgagccgcaacgacgacgtccacgacacccgcggtatcctcctcccatctcgcgggttcgccgcctgcagaggatccagcagctgatccggggtgcgagtcggaacccctcgatcgcgactggggctccacgctgtcccgagcggatccggcagaggtggccgggattctccggcgtctgcacgacgagacgattcatttaggcctgggcacctacaatctgctgctggagcgagcgtgcgaggcagaggacttcgcgctcttcgccaaggtattcagataccttctgctctccaaagccgctcctgacttgacctcttacatgcatgtcgccagggccatcggggatttagatgaccctgaaccgatgctcaggtttgttagagaggtattggaggtcacgcagggtagagatcccacggtggtgaatcgcattgttttcgccacgggtaaatacggtcacatcgataaaagcttgatcatattcgaagagctgaagaaagataagaagtgcttggatgtcgtcacgttcaacaccgtcttggacatgcttgggaaagccggccagattgaccgaatgctccgagaggtgaagctgatggaggagctcggcatttcccctgacatcgtgacatataatacggtgataaactgcctgcgtaggcttggaaggttggatatgtgcaagagctttgcaacggagatggttgagaggggcatcggtccagatttgaga

SEQ ID NO: 2 - DNA, 1158 bp, Lolium perenne
atggctccgcccgccgccaccgtcgccgtcctcggcgacgacctcctgcgggaggtcttcatcctcctccccacccccaccgacctcctccgcgccgcgctcgcctgcaagcccttcctccgcgccgcccgcagcgcccctttcctccgccgcttccgccgccgccaccccttcacctgcccgctcctcctcggctgcctcctccacggccccaccgaccgccgccgcaccaccgcctcccacctgctcccggcctaccccgacgccgccacgcgccgcctcatcgacggcgccgacttcaccttctccttcctcccccgccgcggctggccccaagccgccggcagcgcgtggcagctcctcgactgccgcaacggccgcgccctcttgctcagccgggcttcgagggcgctcgccgtcgccgatccgctcacccggcgctcggtcaccctccccgcgatccgcggcctagggtacgccctcgtcgccgacgacggcgactcgtcgctgttcaaggcggtctgcatttcccgacgcgtcggagccccggggctgcgcgccttcctcctctcctccgccgacctccgatgggtccaagtcgccgtcgctggcctcgacgatgtgcagcccgatctcgccggctcccgcgcgatgcaagccaacggatcgctctactggaagctagtgggcggggagcacatggtggcgctcaacacggagaccatggagttcgccgtgctggagctcccgcctttcttgagggagatcagtttcgacatcattgagaagggggaggacgccgcagctgggctctacctgctcaccatgcgcggattctgcattgaggtttgggccggtgtgaaggacggcgccgacggcgggctgacctggacgctggtggagaagtctgtcatgttccacagggccatggccgagatgcttggttccgaattcctttaccagaacaggctggatgtcatcggggtggttgccggtgttgtgttcttgcgcaatggcgaatgtctcttctccattgatctccagaccatgaagatgaccagggtgtctcccaaggagaattgcccatcccatctgatttatccttgcacgatagcgtggccgccttctttcctgaaccctactgaacaaggtgcttga

SEQ ID NO: 3 - DNA, 315 bp, Lolium perenne
atgagcgcggcggcgggcgggctgcggcagctactgacggcggcggtgacggcgggcgcagcggaggcgcgcgccgcggtgttcggccacgcggtcaacccgtcggggaagcgcgcggcgacgaagctgctgcggaggaagttcatcggagagcagctcgcgcagtggtatccctacgacatcaagcgggacgaccccatcgtcatggcacgcgaggagaaagagcgtcttaccaagcttgaaatgctcaagcgtcgcggaaagggtccgccgaagaagggccagggaaggcgtgcggtcaagagaaccaagtag

SEQ ID NO: 4 - DNA, 240 bp, Lolium perenne
atggcggtgtcggcggacctgagcaaggaagaggctctcaagctggccgctggaatggccttgtcatccactgcggcagtccgcgctagcgcagggaaggccggtgatgcggccaataactcctatgcgcgcagcggatccatctccgcccgcaccagcagctgcgccaccaccacctccttcggctctgcccgcaccaacaccgtcagcgccacactagccctggccgtcagcgcctaa

SEQ ID NO: 5 - DNA, 879 bp, Lolium perenne
atggagatgaagaacggggactacgcctccgtctccctcgagctcgtcaccgcccacgcccaggccagggccaccttcgaggtcaggctgctcgaccaggccggcaagctgccgccctccgtcgtgctcgcccggtacaagcccctgctgttccgctccaacccgcccacctacatgagcgaggacttcctgcagccattgccctacctgcacgctgacgacagcctcgtggtcgagtgcgacatcacagtcatcaaagaatccgagctggccctggttcactctaccttcgacatcaaagtgcctccctccgacttgtcacagaacctcagacaactgctggaggccggggatgaatcagacgtcgccttcgaggtccgaggggaggttttccccgcgcacaagctcgtgctcgcgatgcggtcgcgggtcttcaaagccgacctctttggcccgatgggcgacaggacaaggaagaccatacccatagaggatatgcagcccgctgtcttcggcgcgctgctccacttcatctacacggattcgctgccttccatggagcatcttcacggagatgatgctgaggaaatggtgaagcacctgctcgtggctgcagataggtatgccatggaaaggatgaaggtgatgtgcgagagcatcctttgcaagactcttaatgtccgtaatgtcaccactactctagctctagccgaccagcatcagtgcagccacctcaaagatgcttgccttgactttatcgcttctccggacagaacagatgatgtggtggcaagcgaaggctatgcttgcctcaaaagatcttgccctgctgtcatagcagatatcttcgagagggcaaccaagtctcgcaaaatctag

SEQ ID NO: 6 - DNA, 276 bp, Lolium perenne
atggcggcggtggcgcagcggaagacgaagggttcatcggcggcgagcaccggcggcgccaagacgaagaggaggaggaagacgaaggtgctcccgccgctgctgtcgccggggacggccgtggaggtgctccggaacgggaagtgggtgggcggcggcacggtgacgatccggaacgaccgcacctacatggtcagcctccccgagggcatgaccgtgctcatgacacgggggagggtccggcccaccgccggatacggcacgctttattcgtag

SEQ ID NO: 7 - DNA, 1002 bp, Lolium perenne
atgagaattgcttcaagaagggttaacagtgcaagctgtgatgagattacagcccttcgatcagaagcaaaggttgctagcgagttggtcacatctgtatctcggcgtgtaaaaggtgctggatcagaacagagatctcttcatgcaacatccaatagaatgatgctgtcacaagaagaaatgttcaattacagcacaaaaaagcaacaggcaacacatatattttcaaaccttagaaagcaaatatcctccattttaattgctgacattgaggaactaagggctaaaggatgcattatttcccttgcttgttctgaccatacgagttcagaagctaatgttgccataaacatttcacatagtttgtcttttaaagagtgtcctctagcattatctcctgtttcaagtgaattgtgtttaggtatacattctgatatagctgagcaaaaattagaacactggtcctcagttgcaccacttgcacttgaagttgtcctatcaattggacaaaaggctagagatggaactttatcagataatgacgtaaatgatacggctggagacggaaatattgaaagcatgcttctagttgagaaaggactgcgcgaattagcttcgctcaagataaatgtagccatttttatgattactaagcttccttctgcaggcccagtttatcccgctgaaaatcacagctcttcagagccactcgagttaagtgaggaagagcgggaagatgtacgcttcaagcaggcatggttgacatacttttggaggcgggccaaaaatcatgatgtagaggaagatatagctgacgagcggctacaattttggatagagcaaggcaatcatccagttactacaagcgatgtcatcgaagttgatagaggacttcatgagctgaagaagctgggagtcgagtctcagctgtgggaggcgacgaggagatctctcgacgatgatttcagtaatcatgggagtccatttggatctgaagtttag

SEQ ID NO: 8 - DNA, 510 bp, Lolium perenne
atggagcaatgcgacgcggagatcccatccagtggacgcgggctttcctacggcggcgacagctgcagggaggaccgcctcagcgcgcttcccgacgacttgcttatccatatccttctcaagatcctcgacgccgccggcgccgcgcggaccagcgtcctctcccgccgctggcgccgcctctggaccctcctgccggagctcctcttccccaacagtaacccccatcacatacgcctcgccctcaccgcccatgaagcgccggccctacgcaagctcgccgtcaccgtcacagaccccaaccctgagtccgtggcggcctggcttcccatcgccgcgcgccgcctctctggcgatcttttcctctttaacatggctcagcggaacgaatcggaggacgaggccggggaaagaggcgcctttgagctcccctgcttcgagagggccaccgcaatcgtgctcccctgccaaggggccccttgccccttgacggtctccatcgccgcctgc

SEQ ID NO: 9 - DNA, 489 bp, Lolium perenne
atggagcaatgcgacgcggagatcccatccagggaacgcgggctttcctacggcggcgacggctacagggaggaccgcctcagcgcgcttcccgacgacttgcttatccatatccttctcaagatcctcgacgccgccggcgccgcgcggaccagcgtcctctcccgccgctggcgccgcctctggaccctcctgccggagctcctcttccccaacagtaacccccatcacatacgcctcgccctcaccgcccatggagcgccggccctacgcaagctcgccgtcaccgtcacagaccccaaccctgagtccgtggcggcctggcttcccatcgccgcgcgccgcctctctggcgatcttttcctctttaacatggctcagcggaacgaatcggaggacgaggccggggaaagaggcgcctttgagctcccctgcttcgagagggccaccgcaatcgtgctcccctgccaagggccccttgccccttga

SEQ ID NO: 10 - DNA, 1236 bp, Lolium perenne
atgggggcggatttgggggcggagttgggggcgctcgctctgaagtacaccggggtgtcgctctcggtgtcggactacgactccatcgtcgccatgaacatcttcgtcgcgctcctctgcggctgcattgtcttcggccacctgctcgaggggaaccgctgggtcaacgagtccaccaccgcgctcgtcatggtgtttgcggttttgtctcgctggggccgggtggcatggctcatcactggaggggtgatcctgctcgtcaccaatggggtcaattcgcgcattctggtcttcagcgaggatatattcttcatctacttgctcccgcccatcatctttaacgctgggtttcaagtaaagaaaaagcaattcttccgcaattttgcaacaattactttgtttggggctattgggacattgatatcctttgtaataatcagccttggtgccatgggattgttcagcaaacttgatgttgatccactccagcttggggactatcttgcaattggtgctatcttctcagcaacagattctgtttgcaccttacaggtgcttaaccaggatgaaacacccctactctatagtctggtttttggtgaaggtgttgttaatgatgctacatctgttgtgctattcaatgcaattcaaaacattgatcttgatcatttcgatgcgtttgttctactacaacttattggaaaattcctctacctacttttcaccagtactgttcttggaatagctctgctggatctgagtggtattctcaccgtgttcttctgtggaatagtaatgtcgcattacacttggcataatgtgacagaaagctctagggttactaccaagcatacttttgcaaccttatcattcattgctgaactatttctttttctctacgttgggatggatgcattggacattgaaaaatggagattagctaggagtagggagctaataatatggtgggcaggtctcatgagaggagcagtttcaattgcacttgcttacaacaaggtttttggcttgctgactaagcctctgattaatctcctcatcccaccaaggcctagcaatacagctgatggctcaagccagtcattccttgacccgcttctgagtagcttattgggctccgacttggatattggccaatacccccctcaaaccaaccttcagcttcttctcaccatacaaacacgttctgttcatcgtgtgtggcgcaagttcgatgat

SEQ ID NO: 11 - DNA, 1254 bp, Lolium perenne
atggctagccaaatctctggtactgtagcatctagtggggtgggctataatgatcaatacggaatgccctgtaagatgaaaggactacattgtgtatcattgaattgtatacccccaaatttagaggcaaggaaggggatgagtggatatcacttagtcgtcaggttctgttcaaatgatagatatgggcaaaccactcttaagtccaacagttccatgctcagacaaggtcagagtgtttggtgccgttcttatgggcctcgtggtagcagtgaaactaaagagcgcgagagttctgaagatgacaatgatgcttacagggattttaaagagcagccaagaggaaattcgcaattttcagatgatcaagttgcggctcagaaaaaatcactctactctattcaagggctatctaaagcttgccaatttgtttacaatgatgcaaagtttgtgaatgaaagagctcagagtgatattcttttgctttcacgtggcatcacaaggctaaacaaacgggcatctcaggatgttgctgtattagggttgggatttctcaagcttgatgctcgcgcaaggaaggacactcaaaagattgataacagtgtgaaggagcgagcagcccacctgaccaattttgctagaatactgaaggagcgcgctgaatcagacttgaagaaagcagcagatcagcattggagtgatggtgctttagaggcagatctgcggcgagctgacatggttgttaggcgacgtgccatggaggacgctttcatggctctaaagtttgtacgggatatccatgacatgatggcaaacaaattacaggatcagattccaaaggatgcttcattttcacaggatgcatacctgagtatggcatctgccttgtctgaggctgatggtatcgactacacagatcctgaggagcttgaattattagtagcggctcttattgatctggatgccatggatgggaaaaggagtgtttccttattagctgaatgttcaagctctccagatgttaataccaggaaagctttggctaacgcattggctggcagctccatctatgtggactctagggaatgctgggatgggtgcattacagctagctctgcagcaagagccattgatgaactcagaaagcagtgggagcttgaagagggtgacagtctgaggtttgtcgtgaaccaaaacttggataccaaagagactggtgatgacagttcagcagaagatgatacaaccccgtga

SEQ ID NO: 12 - DNA, 1686 bp, Lolium perenne
atggggcagccgacagaccgtgtggatgatttctcatcgagaggcaaggtggctagggtttggtgtatgcgtgaaagaaattcaactttcaggaaaatcctcggaatttatgtcgaagggcttatttttccagaagaatcacggagccagaagggcaggcctgggggaggcccaggccccccaaacaataggctggcgcggcctgtagggtggcgcgccgccctagcgtgtggcccactcggccagcctctgacgcccccctctggactacttaagggttttgatctaaaaacgcgagacgggaagtcaaagtcgcgagaaaccatccagtacgccgccaccgtcgcgaaactccgtctcgggaccagaaactccgttctggcacctcgccgggatggggaattggaggagatcatcgccatcatcaccaccgacgcctctccatcgaccagccatgtttcccccatccatataggcgcggttgctcggataaggcatcagcttgcatacgcaacccacactttcttcgataaagaggatttcttgtatatccatacacccataataaccaccagcgattgtgagggtgccggtgagatgttccaagtcacctccttgttcagccaggctgaaaaggttgacaaggagcttaaggagaaccctgcaccatctgaagctgatgttgaggctgctaagcttgttgtcaagggaaaaggagatgcagttgcgcaacttaaagcagcaaaagctagcaagcaagagataactgctgctgtttcggagcttacaaaggcaaaagaggttgtcttaaggctggaagagaggtctaagttgaaacctggaattccccacaaagatgatgggtccattgcgtttgagaatgacttcttcaagcgtgcagcctttctgactgtttcaggccaacttcaggttgagacttatgcttgtgctctcagcagtgtctatacctttggacccacattccgggcagagaactcacatacgtcaagacatttggcagaattttggatggttgaaccagaaattgcatatgcaaacttgcatgatgatatgaactatgcagagaggtacgtaaaatacctctgcaaatggttactcgatcattgccgtgaagacatggaattcatggtgaaacatgtggacaagactgcaattgagcgtctggagcttgtttcttccacaccctttgagcgcatctcatatacaaaggctgtggagatcttagaaggtacgggtaagaaatttgagaacaaggttgaatggggaattgatttagcgtctgagcatgagaggtatttgactgaggtgatatttaagaagccagttattgtttataactacccgaaaggaataaaggcattttacatgaggctgaatgatgaccagaagacggtggctgcaatggatgtacttgttcccaaggttggtgaattaattggtggaagccaaagggaggagcgtcttgatgttctcacacaaagaatactcgacgcagatctgcccttggagccttatgagtggtacttggacctcaggcgctttggatctgtgaagcacagcgggtttggccttggcttcgagaggatgatccttttcgccactggtctcgacaacatcagagacgtcatcccattcccaagatatcccggtagggctgatctttga

SEQ ID NO: 13 - DNA, 678 bp, Lolium perenne
atggcgccggcggccgtgaaggtgtacgggtgggcgatgtcgccgttcgttgcgcgcgcgctgctgtgcctggaggaggccggcgtcgagtacgagctcgtccccatgagccgccaggccggcgaccacctccagccggactttctcgccaggaacccgttcgcccaggtgcctgtcctcgaggacggcgacctcacactcttcgagtcgcgcgcgatcgcgaggcacgtgctgcgcaagcacaagccggagctgctggtgggcgacggctcaccggaggcggcggcgatggtggacgtgtggctggaggtggaggcgcatcagcaccacgccccgacggccgccatcatggtgcagtgcatcctcgccccgctcctcggcggcgcgcgcgaccaggccgtcatcgacgagaacgtccccaagctgaagaaggtgctggaggtgtacgaggcgcggctatcgaagtcgaggtacctcgccggggaatcggtgagcctcgccgacctcagccacttcccgatgctgcgctacttcatggagaccgagtacaaggcgctggtggaggagctcccgcacgtgaaggcgtggtgggaggagctcaaggccaggccggcggcgaggaaggttaccgagttcatgccggtggactttggtctgggaaagaaggcagagcagtga

SEQ ID NO: 14 - DNA, 687 bp, Lolium perenne
atggcgcagacggcggtgaaggtgtacgggtgggcagtgtcaccgttcgtggcgcgtgcgctgctgtgcctcgaggaggccggcgtcgattacgagctcgttcccatgagccgcgaggctggcgatcacctccgcccggacttcttggcccgtaaccccttcgcccaggtgcccgtcctccaggacggtgacctcacactgttcgagtcgcgcgcgatcgcgaggcacgtgctgcgcaagcacaagccggagctgctggtcggggacggctcgccggaggcggcggcgttggtggacgtgtggctggaggtggaggcgcatcagcaccaccccccaacgggtgccatcatggtgcagtgcatcctcaccccgctcctcggcggcgtgcgcgaccaggccgtcgtggacgagaacgtcgccaagctgaagaaggtgttggcggtgtacgaggcgcggctctcggcgtcgaggtacctcgccggggagtccctcacgctcgccgatctcagccatttccccatgatgcgctacttcatggagaccgagtacgcggcgctggtggaggagctcccgcatgtcaaggcctggtgggaggagctcaatgccaggcccgcggcgaggaaggtcacggagcacgccgtcaatgccgccaaactttgggctctggaaaaggcagagcagcagtga

SEQ ID NO: 15 - DNA, 478 bp, Lolium perenne
tctcgggaaacacgcattggcaataccggccgatcgatcgacagatcggcacggggtccggcgaggcgcgatggcgtatcgggtgctggaggtgacgctgatctcggccaaggacctgaagaaggtgacggtgttctccaagatgcgggtgtacgcggtggcgtccatctccggcggcgacccgcgcacgccgacgcaccggacgcactcggaccggcacggcgggccgctgcggttcccaataccgatcgccgccgacccccgcgggctcgcactgcacgtgctcctccgctccgagcgctccttcggcgaccgcgacgtcggcgaggtgctcgtccccgtccaggaccttttcgccgcagcgcctctcgccggcgagcatcgccacctcagctaccaggtgcgacgccccatgagcggccggaagcgcggggtgctccacatctcctacagcctcacggacgcgccggcgataggg

SEQ ID NO: 16 - DNA, 2445 bp, Lolium perenne
atggtcttgtcaatagacaccggcgaggtaacggcggagtgtgaacgaatggaggtggttagggttcggggtgaggcatggggattgggaattggagaggatgtgaagatggtctggtcgaggatgcggcgggtcaagtgtcgaggaggggctcggccgctcaagggccggcagagggtgccggagaaggagaacgccccggcagccaagggccggaggggcgccgccggcgcggcggcgaggctcatggagaagatcgtgcccggcgcgccggccatcaagctcaaggcgagcaagaaggaccagtacctgctcaagcgccgggacgacgcccgtgctccggcactgccgccggtcgtgctcccggacgcgacccccgcaccggacgacggcgggccgccgcctggcttcccgtcggcggagccgcagacgccgccgttgcccagcagtgctggaggtggcgacgatgaggagttcatgctgcagagacgcacgctcccgtccgccggtcaggcgagcgacggcggcgcaactgcggacgacgccacagccgccgcgcccaagaaggcagcgaagcccaagaaggcccgcaagcgcgagagggaggtggcggcggaagccaccgccgacgagtccgccgccgccggcgagccaaagacgaagaagaaaaagaagaagctcgctgagctcaacagcggcgcgccctctgccgacccctccggcggcggcgcaaagccagccgctttctcgccccccaaggtcgacctcgatggcctggatctgaaacaggtaatatcggaccttgagaacctcccgctgcttccctcctacggcgccggcagatccatctctgacggatctcactccttcctcctcgccttccgctcgaaacactacaagaagagctatgagaacgatcctagcgaggagtccaagaagagtctggatactaaacccaatgccgccgtcgctgccgctgttgacggccagccgcccaagccggtcaaaaagaagccggtcatgagacccattgaccccaccattgccggcgtgaagcgcgggccctctgaccggcaggaggagatggccaccaagaagaaaataaagctcgagaagattaagacactggcagccgagaagaaggccgggctggagccgaaagtcgtcactgcccctgcctcagctgtgggaggcgttacgccggcggctcagcagccacgtgctggcatgaaggagaaggctctggggttagtcaagaagaaggtgccagcggcggcgccggcgaggaggatggcgtcgcccacggcgctgatgatgaagttcccgcccaatagcacgctgccgtcggtggcctccctcaaggcgaggttcgcgcgcttcgggccgctagacatcgacggcatccgggtgtactggaagtcctacatgtgccgggtcatctacaagtacaagtccgacgccgagatggcgctcaagtcagccaagtccacagccatgttcggccaggtggtccccaactaccacctccgcggcatcgagtcgtcgtcggccggcgctgacatggggcctgagccggctcctcctgcgcagcagcgctccgagttgcggctcatggagaccacgccgttcaggcctgggagctctggcaatggcgctcctctgacgctgtcaagggcggcgccagcgcgcgcagtcgtcgggcagcccaagtcaatcctcaagaagaacaacgacgatggtggggccagcgcgctccgggactcccctcgggtgaagttcatgttggacggtggcgacagcaagctcgagccacctgcaattccggcgagcggcaatagcccggacgctgctgcaccggtgagcaaggtcgcgaggtcggtcggcttcgcacagccgcctctacagccactggcacgccctgcacagcccaacatgcaaccggccatgcgtgcacagcaacagcagctgcagcctccacgcgcactggatacgcaggcacttccaccgccaccgccgctgccgtaccagcctcgtgccagtgagccgttgccgtaccagcctcgcgtcagcgaggcatcaccatatcagccccgtcacacagacgcgccgccatctttcaacaacatgcagctgccgtaccaggctcgccacatcgacgtgccgctcatgctctctggacagccgacgctgccatacccgcctcgtgccagctttgcccgctccgacgacatgccgccgccgtctcactttgacaacaatgcagccaacgccatgccggctccctttgacaggaacgctgtgaacgccatgcccgtgtggaagaggggagagaaggagttcagtgaggagctgatgagggtgatgcttgggatcgccaagctggtggagccattgatggacaagaacggcaacttcccctaccacctcttcggcaggtcagcttga

SEQ ID NO: 17 - DNA, 936 bp, Lolium perenne
atggtagtgccagtgatcgacttctccaagctggacggcgccgagagggccgagaccatggcgcagatcgccgacggctgcgagaactggggcttcttccagctggtgaaccacggcatcccactggagctcctcgatcgcgtcaagaaggtgtgctccgagagctaccgtctccgggaggcggcgttccggcagtcggagccggtgcagacgctggaggctctgttggaggcggagcggcgcggcgaggccgtggcgccggtggacgacatggactgggaggacatcttctacctccacgacgacaaccagtggccatccgacccgccggcgttcaaggagaccatgcgcgagtaccgcgccgagctgaagaagctggcggagcgggtcatggaagccatggacgagaatcttggcctggacaagggtcgcatgaaggcggccttcacttgcgacggcatccacgcgccgaccttcggcaccaaggtgagccactacccgccgtgcccgcgcccggacctcgtcacgggcctccgcgcgcacaccgacgccggcggcgtcatcctgctcttccaggacgacaaggtcggtggcctggaggtgctcaaggacggtgagtggctcgacgtgcagccgctcgccgacgccatcgtggtcaacaccggcgaccaggtggaggtgctcagcaacgggcggtatcgcagcgcgtggcaccgcgtcttgcccatgcgcaacggcaaccgccgctccatcgcgtccttctacaacccggcgttcgaggcggccatctcgccggccgtggccgagggcggcgccgccgcgtcgtacccggagttcgtgttcggggactacatggacgtgtacagcaagcacaagttcgaggccaaggaaccgaggttcgaggccgtcaaggccccaaacacacctcaagcttaa

SEQ ID NO: 18 - DNA, 936 bp, Lolium perenne
atggtagtgccagtgatcgacttctccaagctggacggcgccgagagggccgagaccatggcgcagatcgccgatggctgcgagaactggggcttcttccagctggtgaaccacggcatcccactggagctcctcgatcgcgtcaagaaggtgtgctccgagagctaccgtctccgggaggcggcgtttcggtcgtcggagccggtgcggacgctggaggcgctggtggaggcggagcggcgcggcgaggccgtggcgcccgtggacgacatggactgggaggatatcttctacctccacgacgacaacacgtggccgtccgaccctccagcgttcaaggagaccatgcgcgagtaccgcgccgagctcaagaagctggcggagcgggtcatggaggccatggacgagaacctcggcctggacaagggccgcatgaaggcggccttcacctgcgacggcatccgcgcgccgaccttcggcaccaaggtgagccactacccgccgtgcccgcgcccggacctcgtcacgggcctccgcgcgcacaccgacgccggcggcgtgatcctgctgttccaggacgacaaggtcggtggcctggaggtgctcaaggacggtgagtggctggacgtgcagccgctcgccgatgccatcgtggtcaacaccggcgaccaggtggaggtgctcagcaacgggcggtaccgcagcgcgtggcaccgcgtcctgcccatgcgcaacggcaaccgccgctccatcgcgtccttctacaacccggcgttcgaggcggccatctcgccggccgtggccgagggcgccgccgccgcgtcgtacccgaagtttgtgttcggggactacatggacgtgtacagcaagcacaagttcgaggccaaggaaccgaggttcgaggccgtcaaggctccaaagacacctcaagcttaa

SEQ ID NO: 19 - DNA, 684 bp, Lolium perenne
atgcgcgtcaccatcaccggcggcgggacgaggctgcacgtggacctctactacgcgtgcgtgcagagccgcgcgctcttcacggtgtggagcctcctgcagctgatgcggcggcaccgcggccgcgtccccgacgtggacctcatgttcgactgcatggaccggcccgccatcaaccgcaccgagcacagcggcgagggcgcgccccctccgccgccgctgttccggtactgcaccactcgcgaccacttcgacatcccgttcccggactggtccttctggggctggccggagacgcacctcgagccctggagccgcgagttcaagagcatccggcagggcgccaagaagaactgggacgaggaggcgaggtccgggtaccagaactcgaagctgtcgagccagtgcacgcaccggtacaagatctacgcggaggggttcgcgtggtcggtgagcctgaaatacatcctctcctgcggctccacggcgctcctgatcgacccgctgtaccaggacttcttcagccgggggctggagccgcgggtgaaccacctgccggtgagcaccgtggggatgtgcgagtccatcagggacgccgtggagtggggcaacgcgcacccggacgaggcggagcgcgtcgggcggcgcgggcagcggctgatgcaggacctggccatggacgcc

SEQ ID NO: 20 - DNA, 2241 bp, Lolium perenne
atggcgggccaggggcaggaccgcaagaccatcgatctggaggaaggatgggcctacatggagggcggcatcggcaagctcgtcaacatcctcgagggcaagaacgagccgcagttcaactccgagaactacatgatgctctacacgacgatatacaacatgtgcacgcagaagccgcccaacgactactcgcagcagctctacgacaagtaccgcgaggccttcgagaagtacatccgagacgcggtcttgccagcaataaaagagcagcatgatgagtatatgctaaaacagctaaacgtaaggtggaagaaccataaagtcatggttcgctggctttcacgtttcttccattaccttgaccgatacttcatcacccggaggtctcttactccacttaatgatgttgggtttatttgcttccgagacttgatatttcaagagatcaaaggaaaggtgaaagatgcggtgttagttctgataaatcaagagcgtgaaggtgaacagattgacaagaccttgctgaaggacgtcctggatatatttgttgaaatcgggttaactaccatggagttttatgagaatgactttgaagatttcttgcttaaggatactacagagtactattctgtcaaggctcaaaactggatcgttgaggattcttgtccagattacatgataaaggctgaggagtgcctgagaagagagaaggagcgagttagtcactacttgcatattaacagtgagccaaagttgctggagagagtgcaaaatgaattgcttgccaactatgcaacacaacttctggagaaggaacattctggatgttatgcattgcttcgggatgacaaggtggatgatcttaaaaggatgttttcactcttctcaaaaatcacccgtggtctggaacctgtttctaacatgttcaaatcgcatgttacgaatgagggtacagctttggtcaagcaagcagaagattctgctagtaataaaaagccagagaagaaggagatggttggaatgcaggaacaggtttttgtctggaaaatcattgcactgcatgataagtatgtagcatatgtgacagattgtttccacggccatacactcttccacaaggcacttaaagaagcctttgaggtcttctgcaataagggtgtctctggcagttcgagtgctgaattgctcgccaccttctgtgacaacattctgaagaaaggctgcagtgaaaagctcagtgatgaagccattgaagatgcccttgagaaggtggtgcgcctgcttgcatacataagtgataaagacctctttgctgagttctacaggaagaaacttgcaaggagattgctttttgacaagagtgctaatgatgaacatgaaagaagcatcctgacaaagcttaagcagcagtgtggtgggcagtttacttcaaaaatggaaggcatggttactgaccttactcttgcaagagatcatcaaactaagtttgaagagtttgtagctgaacatcaagagttgcatcctggggtagacttggctgttactgtcttgacaacaggattctggccaacctacaaaacttttgaaataagccttccttctgagatggttaaatgtgtagaggttttcaaggagttctaccaaacaagaacaaagcacaggaagcttacctggatatactcgttgggaacctgcaatatcaatgcaaaatttgaaaccaaaactatagagctcattgttacaacatatcaggctgcgttgctgttgttattcaatggagttgataggcttagttactctgagattgtaacacagctgaacctgtcagatgatgatgttgtgcgtttgctccattctctgtcttgcgctaaatacaagattcttaccaaagagccagctggtagatctatttctcccaatgatgttttcgagttcaattcaaaatttaccgacaggatgagaagaatcaagatacccctgcctcctgttgatgagaagaaaaaggttgttgaagatgttgacaaggacaggaggtatgcaattgatgcatcgattgtgcgtatcatgaaaagccgcaaagtcatggcccatacccagctagttgcggaatgtgtggagcagctcagccgcatgttcaagcccgacttcaaagcaatcaagaagcggattgaggatctcatcaccagggactacctggagcgtgacaaggacaacgccaacacatacagatatctggcttga

SEQ ID NO: 21 - DNA, 1350 bp, Lolium perenne
atggcgcctcctctgccggggccgcgcccgccggcaggcggatcccgccggcctcgtccatgccctgggtccgcaacctccgccgcttcgttggtacgggcgccggcctcggatccgaggccctcatggatgcttaaatcagagacaaaacctgaagatggatctattagcaatagagttcagaggctggcaaaatacaggtttctaaagaaacaatcagagcttctacttaatgccgacgatcttgatgccatgtgggtttgtctcagggaaaattgtgttatagacgatgtgactggctctgaaaagatgaattatgaagatttctgccatattgccacagtgtgcacagagcagattggccagaaatgcaaacgtttctttagcccttcaaactttatgaagttcgagaaggatgattctgggagaattgcaatcttaccattctatctttatgttatgcgaacagtttctcttactcaagcaagaattgatatgagtgaacttgatgaggattctgatggtttccttcaacctcatgaaatggaagcatacatcagagggctcattcccaatttggcacaattgcgcgacatgccatcggcgtttgttcaaatgtactgccgcatagctgcacggaagttctttttcttctgtgatccacacagacgggggaaagcatgtataaagaaagtattgttgagcaattgtcttcaagaactgatggaattgcatcaggagagcgaggaagaggtaactgatactgagcaggctgaaaattggttttccttgacttcagctcagcgcatatgtgatatgtttcttgcactagataaagatacaaatggcacattgagcaaacaagagcttaaggaatatgctgatggcacactaacagaaatcttcatcgaaagagtttttgacgaacatgtacgccggagcaaagttggaggtggcaacagtcgtgagatggattttgaaagctttcttgattttgttttggctctagaaaacaaagatacccctgaagggttgacatacttatttagatgccttgatcttaacggaaggggattcctgacgactgctgatatccatactctgttcagagatgtacaccagaaatggatcgagggtgggaactacgagctttgcatcgaagacgtaagggatgaaatctgggacatggtgaaaccagctgatcctctgaggatcgcactcacggatctcctttcgtgcaagcaaggtgggacgatcgccagcatgcttatagacgtccgcggcttctgggcccacgacaacagagagaacctcctccaggaagaggaagaacaagtggaagaggcttga

SEQ ID NO: 22 - DNA, 1776 bp, Lolium perenne
  misc_feature (36)..(42): n is a, c, g, or t
  misc_feature (201)..(204): n is a, c, g, or t
  misc_feature (386)..(414): n is a, c, g, or t
  misc_feature (557)..(608): n is a, c, g, or t
  misc_feature (917)..(917): n is a, c, g, or t
  misc_feature (1147)..(1147): n is a, c, g, or t
  misc_feature (1531)..(1589): n is a, c, g, or t
atgttccgttccatgacgaaccgggtttgcagaacnnnnnnnggtcacctcctatcctagccagttttcatagagtataccagatcacctcctatcctagccagttttcatagagtacattgcacaaccattctgagacccacgcactacatcggcacacggcagtgcgccgcgcaatccacccttcaaacctccatccgnnnnccataaagcccagcgtgctgccttccatcagggttgtcacatttcagcttcggcattcactgcacattcggtgttcagatatgtgacgttgttttgaacccatggtccctaaagcagctcggcatcatcctggtcaccatcgtcgtcggcttcgttctcgtcctcgtcttcgggtgcatccnnnnnnnnnnnnnnnnnnnnnnnnnnnnngcgctccaatcctttcttagcggcttcattgtatgggtttatccttagtgcagcttgatagtgggagagtgcatcagagagaagatttgtcgccgcaaatacttgagccaacttgatatgtagagaatcatctgcccattgcnnnnnnnnnnnnnnnnnnnnnnnnnnnnnnnnnnnnnnnnnnnnnnnnnnnntcagccagtgccaatgctgctccaagaaatccaggttcgagacgaatggcagattcatagaactttcttgccttctctcttccactggaacttatagcatgcacatcaccaactaacttaagggctttcgcagactgatgcataaccttcattgcttcacgtgcagtgaataatgcatctttacatttagaaagtgctagataagcacgtaccaaaccttgataagagcgaagatcagcccttagctcctgagctgccctgaagtctgttactgccagatctggccgattcgatgaaagatgcaaattntcccttcataatatagccagttatatgcctatcgtcaactcggaggctcttttcagcatatatcaaagcttttctttcatcttttctttcccaaaatgctgccagagcaatacatgtttctggtcttgcgggatcaatatgcagcatatcatgtaccaacttgtttagcctagtgtaatccgatttaaattttaggagaattgcatactcatccatatatgtcataatgntttggatcaattaaccgagccttctcaaaattcatgattgcttcatcattcttgccaatgatggtttcaacctttgcaatttccagcaagatgtgcacattattggggaatcgttgcaatagttccacgtatatatcaaggccacctttataatcatgtgaagcaatgcaacactgcgcctctacatacctattccaccaacgttgtgcatctacaaaatcacctggtggcttgcctcctctatttggtgcttgaagaaataataaagaaaactccttcgaagaaagccccatttcagccaaagctgcaatagcctcaaatacataagggcattgcctcaaacactctttataacatatggccgaagcacggttatttctggannnnnnnnnnnnnnnnnnnnnnnnnnnnnnnnnnnnnnnnnnnnnnnnnnnnnnnnnnnttcattgaagggcgttgcatttgaagaatttggagagggtgagcggcctgtagtggaaactgagattctggtggaacttgttgcttgtttagggatacttttgctacattgcacagcttgcttgtaggcacccagagccctccgaaattccttctccccgtacaacgcatcaccgtgcaggaccaag

SEQ ID NO: 23 - DNA, 854 bp, Lolium perenne
  misc_feature (324)..(324): n is a, c, g, or t
  misc_feature (488)..(488): n is a, c, g, or t
  misc_feature (671)..(676): n is a, c, g, or t
ccccaggttatcgcccccacgaaaaatgctcgaaacttttcccccctttctggctgtgtgaagaaactgctgaccgaaacatgactgaaagcaagttgctaatgaaacccatccagtacctacaaaacctatatgtatataattagcatttgagctgtggaggtcagttcattcttgatttgatcccgcgcaacacaaccgaattttgtgcatttcaccggatgtgcttcgtaacagttcaaaacacttagttgtctaagcaagtgttcttctcgttgcagctccccgaggatattgagtggcatttcattgggaacctgcaanacgctgcttcggcgagaactacgtgcaggagctcatcgacaaggccccccagctccccgaggatattgagtggcatttcattgggaacctgcaaagcaacaaagccaaagctctcctagctggtgtaccaaatcttgacatggttgagagcgtagatgatgagnataatttgagacacaaacttagttggactgatctgcttcatagtgctaatgtactatgtttgttgatcgcataggcactggctagttgtcggaaggaggtatgcgacgagcttggaataccagaagagcaatgtgagttgtcaatgggcatgtctgctgattttgagcaagcgattgaaatgnnnnnngcacaaatatcagagttggatcaactatatttggtgcaagagaatacccgaagaagaactaggataactatatattcaggttttgttgcggcagtgcctgcgtagaatatgtactattctcgtctgcaaataaaatattggtgataaatatgtatccagttcctccaacattccgctt

SEQ ID NO: 24 - DNA, 3195 bp, Lolium perenne
atggggaagccggcggagtacgaggacgacgacgaggaggtgtccacctccgtcggcgacgagcagccggacgaggaggagcaggagtcggacggatccgaggaggaggaggatgagccggagggggagcaggcggcgggggacgccgaggacgaggaggaagaggtggacgaggaggagatcgtggctgccaccacgggcgccggcgccgacgacgacgacgacgccggcgacggcgcgggcgaggcggagtctaccgaggacgacgaggccgtcgcccccgaggagggcggcgaggaagacgccgacgagtctgaagacgccgccggaaacgcagaggttggcaagcgggagcgcgccaagctcaggcagatgcagaagctcaagaagcagaagatccaagagatactggatagccaaaacgccaccatcgatgctgacatgaacaagaaggggaaggggcgtctcaaatacctcctgcagcagactgaaatatttgctcatttcgccaaagggagccaatctgcggagaaaaagtctcgcggaagcgtctgccttctctgttttgctaatgtggttagaacttataggggtcgtcatgaatcaaaggtgacagaggaggaggaagatgaagaatacctcaaggaggaagatgcccttgctagtgcaggaggaacacgcttgcttatacaaccatcatgcataaatgggaagatgagagattaccaactagctggacttaactggctcatacgtttgtatgagaatggcatcaatgggatattggctgatgaaatgaatcatatacgggaaaatttgttagctccagggaagtttgatgtctgtgttactagttttgaaatggcaataaaagaaaaaactgcattgaggcgttttagctggcgctatattattattgatgaagctcatcgaataaaaaatgagaactcccttctttctaagacaatgaggcttttcagcaccaattatcgcctgctcattacgggaactccactgcagaataatcttcatgagctttggtctcttctcaacttcttgttaccagaaatatttagctccgctgagacttttgatgaatggttccagatctcaggggaaaatgatcaacatgaggttgttcagcagcttcataaggttttgcgtccctttctccttcgaaggcttaaatctgatgttgagaaaggtttacctccaaagaaggagactatacttaaagttggaatgtctgagatgcaaaaacagtattatcgtgctttacttcaaaaggatctggaggttattaatgctggtggtgagcgcaagcgccttcttaacatagccatgcaactgcgcaagtgctgcaatcatccatatttattccaaggcgctgagcctggcccaccttacacaactggggaccatctaattgagaatgcaggaaaaatggttctgttagataaattgcttcccaagctaaaggcccgtgactctagagtactaatattctcccagatgacccgtcttttggacatcttggaagattatctcatgtacagagggtatcagtattgccggattgatggtaatactggtggcgatgatcgtgatgcttccattgaagctttcaacaagccagggagtgaaaagttcatcttcttgctttcaactagggcaggtggtcttgggatcaatcttgcaacagctgacattgtggttctttatgatagtgactggaaccctcaagtggatttgcaagctcaagaccgtgcacatagaattggtcaaaagaaagaagttcaagtcttccgtttctgcactgagtataccattgaggaaaaagtaattgagagagcatataagaagcttgccttggatgctttggtcatacagcaaggccgattggcagaacagaaagctgtcaataaggatgagttgttgcaaatggtgagatttggtgctgaaatggtattcagttccaaggatagtacaataacagatgaagatattgaccgcattatcgctagaggagaagaagcgacagcacagcttgatgcaaaaatgaagaaattcacagaagatgccattaaatttaaaatggacgacactgcggaactttatgattttgatgatgacaaggaggaggacaagcctgattttaaaaagctagtcagcgataactggatagaacctcctagaagagaaagaaagcgaaactactcggagtctgaatatttcaagcaagcacttcgccaaggtgcaccagcaaaacctagggaaccaagaattccccgaatgccaaacttgcatgatttccagttcttcaacactcagaggctcaatgaattatatgaaaaggaagtcaaatacctagtgcaaacgaatcagaaaaaggatacaattggtgatggggatggggatgatgaagatcaactggaaccactgaccgaggaggagcaagaggagaaggagcagctgctggaagagggcttttcaacatggacaaggagggacttcaacacattcattcgagcttgtgagaaatatggtcgtgacgacataaagagtatattctctgaaatggaagggaaaacagaggaggaagttcagcggtatgccgaagttttcaaagaaagatacacagaattgaatgattatgaccgaattatcaagaacattgagaaaggagaatcaaagatctctcggaaggatgagattatgaaagccattgcgaaaaagatggaccgctataagaacccatggttggagttgaaaattcagtatggccagaacaaagggaagttgtacaatgaagaatgtgacagattcctgttatgcatggtgcacaaacttggctatggaaactgggaagaactgaagtcggccttccgcatgtctcccttgttccgtttcgattggtttgtgaagtccagaaccacccaagagttgtctagaagatgtgacactctcattcgtctggtggagaaggagaaccaagagtgtgatgagcgtgatagacaggctaggaaagataagaagaacatgacatcctcaaagcgtcctgcggcaagtagtccagcatttgagtctcccatccagagctcttccaagagagggcgccgggatggcagtgcagcctcgtgttcatgggtcaaccagattattgaactggttaaagcttttggtgatctatcgtaa

SEQ ID NO: 25 - DNA, 1848 bp, Lolium perenne
atggggtttggtcgatctcgctggacaggcagtacagcactggttattaattggagaccacttctctactgcagaaaagaggatatcaatggtcacagtgggctgaggagagatttaccggttgcatctttgcttcttcgggtggatgcaagcatgtataagaaccagctccaggagcttgcacagaggagctgcttcaacttgccatcctatgcatgcatacgcgaggggccggatcatgcaccccggtttaaggccacagttcatttcaatggggaagcatttgagagcccgacattctgttccaccttgcggctggcggagcatgcggcagctgaggtagcactcaatgagttgtccaagagggggccttcatcatcacttgctgctaaagttctggatgaaactgggatctacaagaacctgctgcaagaaactgctcatcgggccggtttaaaactgcctatgtacactactattagatccggaccagggcatacaccaatgttcacttgtacagtggagttagcaggaaggatcttcacgggcaatcctggcaagactaagaaacaagctcaaaaaaatgctgctatggctgcctggtctgaattaaaggaattgcctcgagtaggtgaggtagcatcttcatcttctccatccgatcatgacaatgaggagcaggaacaggtcacagttgtccgcactcttgaaagcttgaaccagaaaaatgaaggcaaggcaccacatcaaaaggaaaagcagcaacgcaataaccgcccgcaacctcggagatcttatcctaaaccaagtgcgtcattttacggatcacgcttacaaaatcagacatacccaaatgttgcacaagagcaagcaatgtaccatatgtggcaccaggtgcaaccaacacagcagaagccccattttcggatggttccaactatgggcaacacaaggtttccaccgccaccaactatactctccatgtaccctccacctagaggacagttcgccgtgccagccagccaagatgctttggctctaattccatgttttcctgaagctgctcctgcccttccacggtacttctcgccttaccctgcctcatacgtaccagcaagtccactgccagctgcagttaacatgatgcatgggagaaggcaagggtgtgctgaaacggttgagcttcctgatgcaccagttttcgccagatacactgctccagattactctagtgctctggaaaatgtttgtccaagtgaggttcaacaatggcctaaaaatgggaaagaggcatataccgagagcagtgctgccaccgaggaaaagaataaagctccccagacttcttcaagctccacaacgcatcacccatcacaaaagttggaaccaaatgaagatagagagtcgaaaaagccagcagaacaaccacttcttggtccatatgttgtacaaagacctgtccagcgacagagttatcctagtcccgtgcagcacagcgagcctatccacagaaataatcttccgttcaggacggcaacatcacctggcccatggtcttcggacatgcaaactccaccaagatttggtactgcgactcttgcgaattcagccagtttcttataccagcagcggcctccatggctggcggccccagttacagttcgaacttctatccctgtgtgttcagctagaccaaacgcagcggtgaactctagcccgggagcagcaactcgagtccgatctactgtccagatgctctctagaaataactctgaggcccagaggaacacgagagacatgagtgatgcttcgacagcaagttcagaacttagtaagctccatatctga

SEQ ID NO: 26 - DNA, 1206 bp, Lolium perenne
gggaacattgacatttgctccaatgctcgtaatgtttttgcatataatggaccagtcaatttcactgtacttgagaggctagtaagcagatgccgcaacctcaagactctgaagctcaacaatgcaatccctcttgacaatgttgctagcctgcttcgtaaggctccgcaaataatagaactcggaactggcaaattctctgctgactatcatccagatctttttgcaaaggttgaagcagcatttgcaggttgtacaagcctaagaaggctttctgggacttgggacgctgttccagattacctgccagcattctattgtgtatgtgaaggcctcacatctcttaatctgagttatgccaccgtgcaaggccctgagctcatcaaattcattagcagatgcaagaatctgctgcagttatgggtgatggacctcattgaggaccatggtctatctgttgtggcatcaagttgcagtaaactgcaagagttgcgggtcttcccttccgatccttttggtcataacggcgggcaagttttcttgacagaaagaggtcttgttgatgtttctgccagttgtcccaaattggagtcagttctttacttctgcagccggatgacgaatgaggctcttgttatgattgcaaagaaccgtccaaacttcacttgcttccgcttagccctccttgagccccgttctccggattacatgacacggcagcctcttgatgctggtttcagtgccattgttgaatcatgcaaggggcttaggcgcctctctatgtctggtcttctcacagatcttgtattcaaatcaattggtgcacatgctgatcgtcttgagatgctatcactcgcatttgctggagacagcgatctaggcctgaatgacatcctctctggctgcaagagcctgaagaagctagagatcagggactgcccgtttggggataaagcgttgctggcaaatgctgccaagctggagacaatgcgatccctttggatgaactcgtgctcgttgaccgtgggcgggtgccgactgcttgcactcaagatgcctcaccttactgtggagataataaacgatcctggagagacatgtccagtggagtcactcccgtttgatagccctgtcgagaaattgtatgtctaccggactcttgcaggtcctagatctgacacaccagactgtgtccagattgtttag

SEQ ID NO: 27 - DNA, 2011 bp, Lolium perenne
  misc_feature (427)..(436): n is a, c, g, or t
  misc_feature (847)..(867): n is a, c, g, or t
  misc_feature (1234)..(1240): n is a, c, g, or t
  misc_feature (1560)..(1583): n is a, c, g, or t
  misc_feature (1878)..(1886): n is a, c, g, or t
gcttctctccccggagccgcgagcagcaggcggcggcggagggcgcaaaccgagcggcgggaggctgagggcgcaaaccgagcggcgggaggctgagggcgcggaacaaagtcccgattccatcagttgctcaaggatattgttgacccacaagtcgaacaacccaggcgtattttgtaccagcctaacagcctggaggatctggtattcagctggggagcaccaagcttggtctgaaagcacacttcactggttctaaccatggaagccagttccgtcggcgctgacgtatctgccgaccatgtcatcgccgagttgctcgaaatggggttcgagttcgacaagatcagcgaggcgattggggtcgtgggaccatgccgtgctgatgtggtggagtttatgctgaatgggtctgggggtgagcagnnnnnnnnnngtggggggtcgcaaagacgctgtcctgacaggagcactaggctggctaatcccagggggaaatttaagcagtctagtattaccgatcacatcgcctcaaccactggcagtaaaacggtgtctcgtggcggggaaccgagtacctcgtattcttgtttatcagcctccatcgacccttcattgactgctgctatctgttctaaatcaaagcctgaacctcagtcttcgcttgtgaattcaagaggcgagtttgaccgcactggaaaaattagtgctgttttgcaaaagcatttcggcttctcctgcgtcaagggtttccaaaaggaagccctggatgcttggtttgctcgcaaggattgtcttgttctagcggcaactggatcaggaaagtccctttgcttccagatcccannnnnnnnnnnnnnnnnnnnngctcttttgactaccaagattgtggtcgtcatctcacccttgattagtctaatgcacgatcagtgccttaaacttgcaaaacatgggatatcagcatgcttccttggatcagggcaaccagataatcgtgttgagggcaaagcgatggctggcatgtataagattgtttatgtttgccctgagacaattttgagactgatggaaccgttgaagaaacttgcagaaaagccagggattgcactttttgccattgatgaagttcattgtgtttctaagtggggtcatgatttccgacctgactataggagattgtctgtgcttcgagaaaacttctgttccagcaaattgaagttcttggaacatgatnnnnnnnattcctttgatggcattgactgctactgcaactttccatgtacgagaagacattctcaagtccttgaaaatgtcagaacatacagtggttgtcttgacgtcctttttccggccaaaccttcgatttactgtaaagcacagtaaaacctctgcctcatcatatggacaggactttcaagaacttatagggacttacaatgcttcaaggaatttcagggggaaaggccagaaaattcttcatgaagttgagcctgagtctgaaagcagttcatatgactctctggatgatagtgcatcagacgacgaaaaggaagttcctgnnnnnnnnnnnnnnnnnnnnnnnnacattaaaaaaaataaacttgccaagtctctggtaaaagaaaacaccgaacatgagctggatcagtatccaggagtagatgattttgatgtttcatgtggggagttccttgaaagctcgcggcctgagatctttgcacctcctgtgccatcccatgaaactagttcatcagaaagttttgatcaaggtcctacaattgtgtatgtacccacgaggaaaggaactgtggaactagctaactatctgtgtaaatcaggcctcaaagctgcagcgtataatgcaaagatgcctagagnnnnnnnnnaacatttgaggcaggtgcatgagcagttccattgcaatgccttagaggtagttgtggctacaatagcatttggtatgggaattgacaagtcaaatgtcaggagaattattcactatggtttacca

SEQ ID NO: 28 - DNA, 717 bp, Lolium perenne
atggccttctcgcgccttctcccctcccgccgcctcctctccaccctcctccacacccccaccccgacccccgccgcgcccgccaccgacgccaccaccaccaccccgttcgcccacaatctccaccccgcccgcttcttctccgcgacacggcgggccggaccgggcgccccgcgggagccccgcgcggcggacatcggcgcgcgggcgcggcagctgcagagccggcgcctctggacctacgcgctcaccttcggctgcgcggcggggttcgtggtcaccatgctggccacgtcccaggaccagctcgtcttctacctcacgcccacggacgcgctcgcgcgcttcgccaccgacccctccaagacccgctgccggctcggcgggctcgtcctcgagggctccatcgcccacccctcctcctccgcctccgagatcgagttcgtcgagggcgccctccccgacctcttccgcgagggccactccgtcgtcgtcgagggcttcctcaagcccctctccgacgacctccgcctcgacggcgccggcaggaaggtctccgacaaggcgcgggaggggcagtacttcctgcagggcaccgaggcgcttcttccttcgctcgcgccgcattttttttgctaccatgtctccggtgaggtttccggcgagttcttttgcgaggtctccgatgaggttttttcgataaagggattatattaa

SEQ ID NO: 29 - DNA, 738 bp, Lolium perenne
atggccggagccggctcctcccccctcggcggacaactgtcccggcagcgcgggtggcaacagcggcaagaagaagaagaaaaggaaaacaagaacaagcccgcggcgccggtgccggcgcagggtaacgccacagtggaaggcagcggtggcggcggatccattcccctggagaatcaggacaacggcggcacctgtgatgaagcatccggcgacgagcaacctcaaaagcctgaaggtggtagcggcggaggcccgcacgtggttgccccattcgccatgacgccgcacggcatacagcccatggcacccaccgccaatgccaatgccgccggtggcggtgtaaagaaaaagaagaagggcaagggaggtggcaacggcagtgccaatgccaacgcagacggcgccggtgcaacggcggagatgattccacacgacgcaaccgcgggaaacgccggtcagcacgccgcggctgccgtcgatgccggggcctacccgcccgccacgacgatgagctacccggggtactacgccggcggagggcaaatgccgccgccgtacgccatgagctacagcaccgcgcacccgctccggagcagcgcgtactaccacccgatggtcggcgccgcgtacacgggcggcgccgagtacttccactcgacggcgccgatatcagcggcaccgaggtcgtattacatgttcagcgaggagaacgccaacgcatgcagcgtcatgtga

SEQ ID NO: 30 - DNA, 1902 bp, Lolium perenne
atggctctgagcatggtgctggcgcattattctgaagggttcgacgtggaggaggtcaccgctggcttcccctcggagactggggagttcgatgttgccgaagtgctgcggctgatggatgcggtgcgccccttcgccgaccgagtactggcgaccgcggacttggagactcatatccccagccaagcggctcctggtgacgcggagaaggagccgggcccggtggactaccccgcggagcgcctcttccatgctgctgccgccggctcgctgtctacatatccggtcgtggtcagtcgccttgcgaccccaatgaaggctatcgacttgactgttttccttttcgagctgggcgtccccagtcgcaccttctcggcggcatccttctcggattcggccaccgcacgccggaaggccgcctcctcctctgccgcctccgcttccttctcgccggctcgcggatctcctccgcttcctccgccgctcaccgcttatacccctgccgggcagttacagagccagcacctgaacagcctgctgtctgaccgcgattacacctggaacgacaacggcgaactcatccgcatcagcagcccgcgccagacccggagttacagctacagcaccaccggcaggctgaccggcgttcacaccaccgcagcgaatctggatatccgcatcccgtataccacagacccggcaggtaaccgcctgcccgacccggagctgcacccggacagcgccctcagcatgtggccggataaccgtatcgcccgtgacgcgcactatctttaccggtatgaccgtcacggcaggctgacagagaaaaccgacctcatcccggaaggggttatccgcacggatgatgagcggactcaccggtaccattactacagtcagcaccggctggtgcactacacgcggacacaatatgaagagccgctggtcgaaagtcgctatctttacgacccgctgggccgcagggtggcaaaacgggtgtggcggcgtgaacgggacctgacgggctggatgtcgctgtcacggaaaccgcaagtgacctggtacggctgggacggcgaccggctgaccacgatacagaacgacaggagccgcatccagacgatttatcagccggggagcttcacgccactcatcagggtcgaaactgccaccggtgagctggcgaaaacgcagcgccgcagcctggcggatgcccttcagcagtccggcggcgaagacggtggcagtgtggtgttcccgccggtgctggtgcagatgctcgaccggctggaaagtgaaatcctggctgaccggcttccattgcccaagcatatcaatgaagaaaatatattaaacgagatctccattgagaaagatgttgatggttttcatcctctgaacattggtaagctcgcaatgaaaggtagagatcctctgttcctaccttgcacgccaaagggatgcatggagctcctatcacgaagtggagtcactgttaaaggaaaaaatgcagttgtggtagggcgtagcaacattgtgggtttaccagtatcccttcttcttctgaaagcagatgcaaccgtgtcaatcgtgcattcacggacccctaatcctgaagtaattgtgcggcaagcagacatcatcattgcagcagctgggcaggctatgatgatcaagggagactggatcaaacctggtgctgcggtcatcgatgtcgggacaaattccatcgacgacccaacaaggaagtctggatacaggcttgtcggtgatgtggatttcacggaggcaagcaaggtcgcaggtcacctgactccagttccaggaggcgttgggccaatgaccgtggcgatgctgctgaagaacacagtggacggcgccaagaggggaatagtctcatag

SEQ ID NO: 31 - DNA, 3576 bp, Lolium perenne
atggcaacaccccttgcttccgcccctccaccctttatccccgttcagctggatccttcgaaggattccgacaagaacgtcgagggaacatctgctcacccggagaaaacctccggagcagatcaagcagagcagaaggcggaagaagtggccgccaaaaaatccaaagctcgccagcgggacagtgaagccaaggggaaatggtggccctgcaccaccaccgaaacagaactcaacaacctcgaggcggagggcttcctaaggcccggatcctggcggacagtttcgggttctctggttccagctcccgaggccggagaaatggtggtgaccaaggcgctggtggagcgcgacttctcatttccgccatgtgatttcttctcggaaatcttgaaggcgtatgggctccagccccacaacatctccccaaacagcgtcctggccatcagcaatcacgtcactctttgtgaaggccatctccgggacgtttccgacccggcgagcgagagggtgctgccgcccttcaagaacagccccaccagcgagaatccggcctggatgcaatgtcctcatcttttcgagtcgcctcagctgactcgcgcagttaggcggatctgcaagctgacggaggaaggtctgtcggggaaggacctcacaatgtcctggttcaccaagtggatccaaccacttcaacatcgggacagcctgatgttccaatacacgggacgcgatgatcctatgcgcgcctctaaggacaacctttctgctgacgccatcgataagcggatccaactcctcatcaagattccgcgtgatcttcggattcacgtgtgtaacaaggacatccacaccaacggctccgggaccacgctcgaagccctcgaggagggtgaactcggaactctcctccgggttccgcacgcgggcaacactgacccggaagccgtatcggaggcggaagctcccgaggctccgcgcccctccaagagaacgagggctgctccctccagccccgcagccaaatgtgcccgcgaagtgcccagcaccgcggctacccgcaaggcggaggcggagaagaagcgcctcaagcttatcgacaccagcaaccgcgcacaacctgacatgaaccattttttcaagccttccggaagttccggaagccagccctccaagatcctgaagaaaagaacgaagccgtctcctgcttccattccagtcacaccgaaagttgaggttccgcccaaggcctcttctaccgcatggccggatcccaaggacgtcatcaatcttgatgaccttcccgaagaaccaactgctgagaccggccacggcgaatccggcaagggcgcctcctcgtctgctcctccacctgagaagccaaccgccacctccactgaagctccggctgaggaggttgaaaagaaattcttgctaagtcgtgccaccggcacgccccagacccatcctcatctttttccaactttgcaaaagccccccctctcacagcgccacgcggagatatccgccatgatggaccaagtgtgggggcctgcgaacacggaaatgaaggagctctcagatctcgagagtgatctcaagattttctttgctaagcacaagaacgtgcgccagaggtgtgttgctttacccataagagatcttaaccttggtgccaaccgggcagctctcccgttcacacttcctatggtggatctccatgacagactagagaggcccgagtatgtgagctttcctgttttactttcaccccttctagataacctaagtgcaatcaagagataccagatagcaaaagtatacaggagggataacccatcaaagggaagatatcgagaattctaccaatgcgacttcgacattgctggagtatatgagccaatggaaccagatttcgaggttatcaaagtattgactgaattgctggataagctggatattggtgtgtatgaggtaaaattaaatcacagaaagttgcttgatggaatgttggagatctgtggcgtgcctgctgagaagttcagaacagtttgctcaagtattgataagctagacaaacttacctttgaagaggtgaaaaaggaactggtggaagataaaggggtatcggatgaaaccgctgaaaatattggcagtttagtgaagacaaaagggccaccactggaagttttgctggaattgagaaaggagggtagcaagttcatgcaagaacgagaagttacagcccccgtgaccgatctccaaggcgtcgcagtgtttctccagcgccagcccgtgggcgcagctacagcaagtcaccaccacacaaccgtggccgtgatgattctcctgatgctaaaggtgatggaggtgccaggtaccgacgcagcaggagttaggcctgaagcctttgccccatgcatgctcttcaagagaacttaccatttgccctgcgtgctaggaatactaagacctgacgtcaacttcttgacttcggttaagatggatcccaagagaatattcaagaagatgcaaatatctaagcttggggatgcccaaggcatccccctattcatcaaccaacatgaggttgtctccttcaaactcaatattacccatccacatattgaggagatgagaaggattcgagaggatccatttcttcaatgtgaaggtgacaccaatattaaagatagctatgtacttccagatttgaatgaacatgagaatgaagtagctaacgaacctgaacctgaacttgaacatgtgaagaaaaagcagaagacggttaaaagaggacccgaaccagcaacgagatgtcattcctttgtgcaaattgatgacatactagactacataccatcatcaaatgaatatgagttccatggttttctaaaggatgaagatgatgattattttcaaccaatcacgatggtgccaccaaagggtagaaagagtcgaaggaagaaaatccccccaagaaaatggtatgatgagaagaggctgcaaccacatgaacaattgtgtttgaaaatgtgttttaccaatgtgcaacaatttagaaatgctttgattgatttgtacattgcacaaagccgaaactacatgtaccacaggaactccaacataaggatcattgtgaagtgcataaagcagaggtgttcctttctacataaccttgcaaaagcctataaaggccgtcgcgtggtagaagacgtcagcctgaccgtcaactccggggaaattgtcggtctgctggggccaaacggtgccggtaagaccaccactttctacatggttgtaggcattgtgccgcgcgatgcgggcaacatcattattgatgatgacgatatcagtctgctgcctctgcatgcacgcgcgcgccgcggtatcggctatctgccacaggaagcctccattttccgtcgcctcagcgtttacgataacctgatggcggtactgcaaattcgtgactacttgtctgctgaacaacgtgaagaccgcgctaacgagcttatggaagagtttcacattgagcacctgcgtgacagcatggggcagtcactcgtccgggggtga

SEQ ID NO: 32 - DNA, 840 bp, Lolium perenne
atggggtggttcgcgtcatggcgaataaagtggcccgagctcgccccccatctcgccggcaacggcgacgagtttctgggtcctctgggtctcgcgggtggcgtcctggcgaggtggatgtcatccttcgtcgagcttttgtcctcccggcctcttcctcgcgctaccgtcggcgtctccttgggcggtggcaggcctgtggtggtggatggcgccgggcctggttctccagttcctcgtcgtcgtctttgtgcaggagtcaaggtgtctcgatctggggtcgacgagcgacggtgctcgtgcccggatctggttgttcttcagctgtttcctcctctgaatcaagcagatgcagaccatggtgtgtgctctggctggctttggtggtctgacagccggagtgaatcggggcgtgtcccccgccgatgcgtgttcattctccatcagatctcggcgtccgcgtcgggtggtttttgcggcgacatcaacgaggtttactcctcaaaagtttctctccggcaacacagctgcggcctgcgaggcctcttctcgttctccggcgaggttgaggcattggcgaaggcggtggccgatcacggagaaagagagatccaggaggagctagcggagatggcggactggggtccggtggtcatcgcgacggtgctcttcgtgctgctcacgccggggctgctcttccagctgccggggcacggccgggtcgtggccttcggcagcatgcacaccagcggcctcgccatcctcgtccacgccgtcatctacttcgccctcatcaccatcttcctcatcgccatcggggtacacatctacgccggatag

SEQ ID NO: 33 - DNA, 5091 bp, Lolium perenne
atggccgagtgtccaggacattttggtcaccttgagctcgcaaagccaatgttccacattggattcatcaagactgtgctctccataatgcgctgtgtgtgcttcaactgttccaagatcctcgtgcctgaggaggaccccaagttcaagcaggctctgaaaatcaagaatccaaagaacagattaagacgaatctatgatgcttgcaagagcaaaaagacttgcgatggtggtgatgaacttgaggctcaggatcagcaggacactgatgaaccagtaaagaaaagaagtggttgtggtgctcagcagccaaatatcacagttgatggtatgaagatggttgcagaatttaaagcaacaaagaagaaaaatgatgatcaagatcaactccctgagccagtggagcggaagcaaattctctctgccgagagggtacttaatgttctcaagcgtatcagtgacgaggactgtcttttattgggcctgagtgctaaatatgctcgacctgactggatgatacttcaagtacttccgattcctccaccacctgtgagaccatctgtcatgatggatacttcctccagaagtgaggatgatttgactcatcaattagcgatgataattcgacataatgagaatttgaggaggcaagagagaaatggagcaccagctcatattataacagagtttgctcagttgttgcagtttcacatcgcaacatactttgacaatgatcttcctggacaaccaagggcaactcagcgttctggaaggcctattaagtcaatttgcagcaggctgaaagcaaaagaaggtcggattagaggaaatttgatggggaagcgtgttgatttctcagctcgtacggtcatcacaccagatcccaatatcaacattgatcagttgggggtgccatggagtattgcattgaatctgacatacccagaaactgtaaccccatacaacattgagaggttgaaagagctagtagaatatgggcctcaccctccccctgggaagacaggtgccaagtacattatcagggaagatggtcagaggcttgatctacgctatgtgaagaaaagtagtgatcagcatttggagctgggctacaaggttgaaaggcacctcaatgatggagattttgttcttttcaatcgacaacccagtcttcacaaaatgtctattatggggcatcgcattaaaattatgccctactcaactttccggctaaacttgtctgtcacatcaccatacaatgctgattttgacggggatgaaatgaatatgcatgttcctcagtcatttgagaccagggctgaagttctagagctgatgatggtgccaaaatgtattgtgtcacctcaagcaaataggcctgttatgggcattgtccaggacacgcttcttgggtgtcggaaaatcaccaaaagggatactcttattgaaaaggatgtatttatgaacatcttaatgtggtgggaagattttgatgggaaggttcctgcccctgccattttgaaaccaaggccaatttggactggcaaacaagttttcaacttgattatccccaagctaatcaatttgattagattttcagcctggcatgctgaaacagaaactggatttattactcctggtgataccatggtccggatagagaagggagagcttctgtctggtacactttgcaaaaaaactcttgggacaggaactgggagtcttattcatgttatttgggaggaagtagggccagatgctgcacggaagttcttgggtcacacacagtggctggtcaactattggctcctgcaaaatgggttcagtattggaattggggatacaattgcagatgcaagtaccatggaaaagattaatgagactatcggaaaagctaagaatgacgtgaaggagcttattaaacaagcacaagaaaaaagtttggaacctgagccaggacgcacaatgatggagtcttttgaaaacagagtaaaccaggttcttaacaaggctcgtgatgatgctgggagtagtgctcagaagagtttatctgagagtaacaatttgaaagctatggtcactgcaggctcaaaaggaagtttcattaatatttcacaaatgactgcttgtgtcggacaacagaatgttgagggcaagcggatcccatttggttttgttgatcgtacattgccccacttcacaaaagatgactatggtcctgaaagccgtggatttgtggagaactcttaccttcgaggtctaacaccacaggaatttttcttccatgctatgggtggtagagaaggtcttattgatactgccgtgaaaacttctgaaactggctatattcagcggcggcttgtgaaggctatggaggacatcatggtcaagtatgatggtacagtgagaaattctttaggtgatgtcattcagttcttgtatggagaagatggcatggatgctgtgtggattgaatcacagaaattggactccctgaagatgaaaaagaatgagttcgataatgtatatcggtatgaactggatgatgagaactggaggcctacgtacatgatgcctgaatatgttgatgatttgaagaccattcgagaattcagaaatgtgtttgaggcagaggttcagaaattagaagctgaccgtttacagcttgggactgagattaccacaactggcgacaacacatggcctatgcctgtgaatctcaagcggctgatctggaatgctcaaaagacattcaagattgatttaagaagaccttctgacatgcacccgatggaaattgttgaagcaatagataagctgcaagaaagacttaaggttgtccctggtgatgatgcaatgagcattgaagctcagaagaacgctactttgttcttcaatatcctgcttcgtagcacatttgctagcaagagggtcttgaaagaatacaggcttacaaaggaatcttttgaatgggtcattggtgagattgaatcgagattccttcagtctttggtagctcctggggaaatgattgggtgtgtggctgcacagtccattggagaaccagcaactcagatgacgctgaatactttccattatgctggtgtcagtgcaaagaatgttacccttggtgttcccaggttgagagagatcattaacgttgccaagaagataaagactccatcactgtctgttttcctgaagcctgaggtgggcaagaagaaagaattggccaagaatgtccaatgtgccctggagtacactacactacgtagtgtgacgcatgccactgagatatggtacgatcctgatcctctgggaaccatcattgaagaggatgtggaatttgtcagatcatactatgagatgcctgatgaggatattgacccggataagatctctccttggctgctgcgtattgaactgaaccgtgagatgatggttgataagaagttgagcatggctgatatcgcagagaagatcaatcatgaatttgatgatgacttatcatgcatattcaatgatgataacgcagataagctcatcctccgtgtccgtataacaaatgatgaagctccaaagggagaaatacaggatgaatctgccgaggatgatgtctttctcaagaagatcgaaggtaacatgttgaccgagatggcccttcgaggcattccagacattaacaaggtcttcatcaaatacgggaaggtcaataaatttgaggaaaatgaaggtttcaaacccgataacgagtggatgcttgatacagaaggcgtcaacctcttggcggtgatgtgtcatgaggatgttgatgctacaaggacaacaagtaatcatttaattgaagtcattgaagttcttgggattgaggctgtccgcaggtctctcttggatgagctgagggtggtcatatcttttgatggatcttatgtgaattacaggcatctggccattctatgtgatacaatgacatacagaggtcatctgatggccattactaggcacggcataaatcgtaatgacacagggcctcttatgagatgttcctttgaagaaactgtggatatcttgcttgatgcttctgtatatgccgaatccgactacctgagaggtgtcactgagaacattatggttggccagcttgctcctattggtacaggaggctgtggattgtatctgaatgacaagatgctacagcaggccattgagcttcaactcccgagctatgttgacggtcttgactatggcatgacaccagggcgttcacccatctctgggacaccttacattgatggaggaatgatgtcaccaatgctgagtccgaatttcagggcttcccccattacagatgctcagttctctccgtatgttggtggcatgtcgttctcgcctattccgtcaaactacagcccatcctctgggggtggttacagtccatcttctcctgttttcagcccagggccagggcaagcatatagcccgacatctcctgcatacagcccgacgtcgccatcttacagcccaacatcaccatcttatagcccgacgtcgccatcatacagtcctacatctccttcatacagccccacgtcaccatcatacagccccacgtctccttcatacagccctacatctccatcatacagccctacatcgccctcatacagcccaacatcgcctgcatacagccctacatcgcccggctacagcccgacgtctcccagctatagcccaacttcgccgaattacagtccaacttcaccgagctacaatccttcttcggccaagtacagtccttcacatgcttactctccaagcagcccaaggatgatgagcccttatagccaaacttctccaaactacagccccacctcaccgtcttactcgcccacctcaccgtcgtatgcacaaccaagcccgtcatatagcccaaccagcccgcacactacctccggaggacctagcccagattacagcccaacttctccaaattacagccctagcgcaagctactcccccactgcaccaggctactccccgtcatccaccgggccgcaaactactgacaaggacgacgagattgctccttga

SEQ ID NO: 34 - DNA, 405 bp, Lolium perenne
atggggtactcctccaagcgcctccacgccagcatcctggcggtggaggccgggcaggacgcggtgatcaggatgctgctgtaccagcgcgccgacgagacggtggcgccgtacaggggccacacggtggcggagttcacgcggcggatctccgactggcggaacggcatgtccgggtgcggcgccaaggacgagggggtcaaggtgctggaccggcggcagggggcggagcggaggaccatcagcaacatcctcggcgcgggggtggactcgctcgggtaccagcgcacgccggcggaggcgctgcgcatcctctacggctcgcgcaacgagcaggtgcccggcgggttcctgccccatggcgctaatggcaccatcgccagaggattcttccagctcgcgtag

SEQ ID NO: 35 - DNA, 759 bp, Lolium perenne
atggcgcagtccggcagcgacgccgcaccgatcagcacgcaccccaccgaggaggaggaggtgacggtggagaggacgccggaggaggaggcggccaggctcaggtacctcgagttcgtgcagcaggcggcggcgcaggcggtcgtgctggccgccgcggcctacgcctacgccaagcagggcgcggggccgctccgccccggcgtcgaccacgtcgagggcaccgtcaaggccgtcgtcggccctgtgtatgatcggtaccacgccgtgccgctcgacctcctcaagttcctcgaccgcaaggttgacgagtccgtccaggagctggaccgccgtgtccccccagttgtgaaggaggtgccaacttatgcccgctctgcggcggctgaggtgcacaagaccggcttagtaggcacagccacgggcctggccaagtcggccattgctcgtgctgagccaaaggctcgcgacctgtacacccgctacgagcctgtggcggagcgcaaggctgccgaagcatgggctgccctcaaccgcctcccgcttgttccatcggtgaccagggctgtcctccccaccgctgcacagctctcagccaagtacaactctgccgtgcttgacggggccaagcgcgggaactctgttgccacctacctcccgcttgtccccacggagcgcatcgcgagggtgttctcctacccgcctaccgacgctgctgccacctcggctcctgagatgcagcccatcccgacgcagtaa

SEQ ID NO: 36 - DNA, 2109 bp, Lolium perenne
atgcaggagggcggcggcggccgtgcggtccgagcaggacggtacccgcccctcgcctccctcgtcgtctccaccatcgccgccttctccgccgtcatcgtcatcgccgtcctccactcggcgtacgacgacgctctgtcccggacgcggacgctgctggggcacaacctggagccgacgccgtggcacccgttcccgcacgacaagggccgcccgccgccgcgcgccgcgctccggtgcgcctcctacctcgcctgcctcccgccgctctcgcagccgcggccggctgcggcggcgctggcacccaacaacgcgtcgacgaggccgcggcggcagtgcccgtcctacttctccgccatccaccgcgacctcgcgccctggaagcgccgcgccgatggcgttggcggcgtcacgcgcgctctgctcgagtcagcccgcgccagggcatccatgcgcgtcaccatcaccggcggcgggacgaggctgcacgtggacctctactacgcgtgcgtgcagagccgcgcgctcttcacggtgtggagcctcctgcagctgatgcggcggcaccccggccgggtccccgacgtggacctcatgttcgactgcatggaccggcccgccatcaaccgcaccgagcacagcgccgagggcgcgcccccgccgccgccgctgttccggtactgcaccacccgcgaccacttcgacatcccgttcccggactggtccttctggggctggccggagacgcacatcgagccgtggagccgcgagttcaagagcatcaggcagggcgccaagaaggtgcggtggccggaccgggtgcccaccgcgtactggaagggcaacccggacgtggcgtcgccgctccggctagctctcctcgcctgcaacgacaccaacctctggcgagccgagatcatgcgccagaagaaacagtggaaggacgagctccgcaggttgaaggagatgaagaagaggggcaagtctgatatggacgcttatgggtatgctagtattgcaggagaaaacgatcaggatcctcctccagaaaatgtttcagtccctttacctgacatggtgctgcctccttcatttgattgtgacaatccgacataccggtaccgctttctggaaccaacctctactgtccttgctaggcctgttttagatgcgcatgggtgggatcatgactgcggttatgatggagtaagtgttgaagagtcactcgcgctccttagcaagttcccagggactgtggcagttcaggttaccaaggacaagaaggaatttagcatccatctagattcttccatctcagcaaagcatggagaggatgcgtcttcccttgctggttttgacatccagactgttgggcggcagcttgcgtatattcttcgtggtgagaccaaattcaagagtatcaagaagaacaagactactggaggattctctgtgactttcttgggtgacattgtggcaactgggctgaaggttgaggaccagctctctgttggtaagaggctggcattagttgcaagtacaggagcaatgcgagctcaaggggatactgcttatggagctaacttggaaatgcgcttgaaggacaaagactatccaattggccaatccttgtcaaccttgggcctgtccctcatgaagtggcgccgcgaccttgcccttggcgctaacctgcagtcccagttctcgatcggaaggggttcaaagatggcggtccgccttgggctgaacaacaagctgagtgggcagatcaccgtcaggacaagcacctcagagcagatgccccctaatcccatggaggaagaggatccggagtccggagagagtgatccagatcacatgcacgttatagggcagcaatggagcggcggcgtggatcggctcgccggcggtgagtcgccgtcgtcggaggtttattcgtgtgcgtctgttatggcgacgaaaactacagtggcaacgtcagatcttgcagcatctgggtcgggcaccgtcggtgtagatgaccgagaagttttgatggtgaagctcggacttcgcgaggaggaccttgatgacattgtgttagaggaagaaggaagccaacatgagtag

SEQ ID NO: 37 - DNA, 1023 bp, Lolium perenne
atgtcagagccggatgcgaagacaaccattctgggttcttctgtctttcagttcagagtcgactacgagcaaagtaagcagcttcccatcgggaaggccgtccggtccgacgttgtctcggcagggggacacctctggagggttgattttttcccgcgtggagagactgacgaagacaatggcgagtatacttctatcttcctcagccacatgagcaaatcctgtagtgtcaaggccgtcttcgaggctttcatgatgggtgggaacagcaaactgtctacgtccttgaacgcaggaaggacattggaaaccttcgaaatcttgggagataaagacttcgttgacacctggggatggactcgtttcatcaagaggacttctgttcaggaaaatttcttaacagagggtcacatcacacttgtgtgcgccgtcatggtcatcgatgacagtcctattcctgtgccgccttcagacattgggacccatattggccgcctgctagatgagactgacgggacagatgtggcattcatcgtcgacgacaagacattccctgctcaccgagcagtgcttgctgcccgctcaccggttttcaaagcagagctattcggttccatggccgagtctacaatgttgtccatcacgctgcacgacatcacacctgcaacatttaaaactttgctacggttcatatacacagatgaattgcccgcagaagatgaccatcaggactcttccactgagatgattcagaatctactaattgcagccgatcggtatgcgcttgacaggctgaagatcatctgtgctcagaagctatgggataaagtgtcggtagatacagttgcagctatcttaggtttcgccgaaacatacaattgtcaggagttgaaaaacaagtgcatcgacttctttgcagtggagaataatttcaaacaggtcatgttcaccgatggttacgcaatgttgcttctgaagttcccattgatcattgctgagctgaagaagagggttggggcataa

SEQ ID NO: 38 - DNA, 828 bp, Lolium perenne
atgctgcgcctgaccctgccctgcccttccaccttgctgatctggcaggaaattctctcatggcaccggatgacctgcagaccaccagcccaggagatatccctcactgaatggtggatagaagcaagacaacgcctggcccccgcgacgctgctcatcctgtggatgacctggaaacaccgcaacagttgcgtgtttgagggtgcacaacctttgatcaatggtctgatctccagcatcaaagatgaaacaattctctgggctaaagccagtgccactggcctaggagtagtgaccgatgacctgggatgttctccatgggttattctaaatcggcggtttatagagtattgtattcttggctgggagaatcttcctcgggttcttctcatgtacttcaacaacgtagtgctgcctcaggaaggatacttccactcagtcatatgcaactcggttgatttccgtaattccactgtgaacaatgatttgaggtacaaggtgtgggatgaaccacctcagacagagcccctatttctgaacatggcacattatgatgagatggtgaacagcggacagccttttgcaaggcgttttcagaagaaggaaccattgctggacaagatcgatgacaaactactcaggcgtcctgggcatgggcctgttcctggtgcctggtgctcaggcaggaagggctggttcgttgactcatgttcccagtggagtgacgtgaacgttgtgaaacctggtcctcaggccttgaagttgcagcaatatatcaatcggacattggaagaagcaaattctggcgcaaaatcatgcaggcgatag

SEQ ID NO: 39 - DNA, 2796 bp, Lolium perenne
atgggggcggcggagctgctgtctttgtgcttggtactcgctgcggtggcatggacggaggggcagcggccccgcgcggtgaaagtgggcgcgctcttcgactacgattccaccattggccgcgcggcgcagctcgccatcgagctcgccgtcgacgacgtcaacgcggaccgctccgtgctcgcagggaccaagctggacctcatcacggcggacaccaactgcagcggttttgttggaaccgtccaagcactgcaactaatggagaaaaatgtggttgcagttgttggcccgcagtcctctgtgataggccatgtcatctcacattttgttaatgagctgcatgttccgctcctatcattcgcagccactgatccaactctttctgcatcggagtattcttactttttaaggagcactgtcagcgattacttccaaatgcgtgcgattgctagcattgcttactactatcaatggaaagaggtaactgctatatttgttgatgatgattatgggagaggtggggtgtctgcccttggtgatgcccttgcaacaaagcgtgccagaatttcatataaagcagtaattcctccagatgcgaacaaagatgtgatcagtgatatactgtttaaagttaacatgatggaatcaagggttctggttgtgcatgtcaatcctgatacagggctgcgattattttctatagctaacgagctccagatgatgaccggtggctatgtctggattgtaactgattggctagctgctgtcctggactcctcaaagtctggatatccgaagagcatgagttatatgcaaggattaattgcccttcgtcagcacattcctgattctgctgccaagaagaagttcatatcaaaatggaatattgcggctcgcaaaaggaaaattgcatctggtttgaattcgtatggtttttatgcttatgattctatttggattgttgcccatgcgattgataaatttctcaatagtgggcagcagatcaacttctctgcagatacaagattgcacgattcggatacaagcattatcactctgtcaactctcaagatatttgatggtggtgaacacttgctacagcaacttctgctcacaaactttaaaggcctaacaggtctggttcaatttgattcagaccgcaatttggtacacccagcatatgagatccttaacattggtggttctgttcctggtttgattggctattggtctaattattctggcctttctgttgctgctcctgaaactttgtatcagaagccaccaaatatgtcgtcaagtgcccaacagttgagcactatggtgtggtcaggtggctctaccactaaacccagggggtgggttttcccaaacaatggccagcctctgagaattggtgttccaaataaaccaagtttcaaggaatttgtggcaagtggcaaaggtcctgataacgtgacaggttattgcattgatatattcaatgcagcagttaaactgcttccttaccctgttccttccaaattcatatcaatcggcgatggtatacataatcctaaatatgatgacatcattaatatggttgcaaacaataccattgatgtagctgtaggcgacttcgctattatcaaaaatagaacaaggattgcagaattcacacagccctatattgagtcagggatggtgatagtagcgccagtgaaacagtcaacttcaagtgcatgggctttctttaaaccattcacattagagatgtggtgcgtaactggtgctctttttgtctttgtgggaatagttgtttggattctggaacatcggactaatgaggagttccgaggcactccacagcaacaagtccgaacaatattttggtttgctttctcaacaatgttctttgcacaccgagaaaacaccgtaagtggtcttgggcgtttcgtcctgatcatatggttatttgtggtgctgatcatcaactcaagttacactgctagtttgacgtcaatcctcacagtccagcagcttgtaaccggagttactggactggacaatttgattgcaagcactgtacccattggacacccggctggaaaatttatccgaaattatctgattgaagagctgaatattcatgaatcccgcctggtgccactgaacacgatccaggactatgcggatgcccttaaccgtggaccaaaagctggtggtgttgctgcagttattgatgaaatgccgtgtgttgagctcttcctgtcataccactgtaacttcagaatagtaggtcaggagttcacaaaggagggatggggatttgcatttcagagagattctccgcttgctgcagacatgtcaacggccatccttcaactttcagagactggccagctccagagaattcacgacgagtggttgacgcggccaagttgcagctctgatgatagtgggttgggaccaagcaggctagatcttggaagcttctggggtcttttcctgctgtgtgctatgatctgcctcttctctcttggggcgttctttgtaaaaataagctgccagtacagcaggtactccagttctgtggctgctggcgaatccagtgaagcttctcctacctcccctgctgtttctgaagtacacccgacgaaaccaaagccaagacgtcttgatagcttcaaagatctgatgcattttgttgacaagaaggaggaagatgttaaaaaggaaatgaaacagagatcaagcgataaagataatcatggcgtgggatcctcagatacacactttgtctcttcagcatag

SEQ ID NO: 40 - DNA, 432 bp, Lolium perenne
atggcaccggcgtctacacgcgcggcagcggcactccacggcgtgactttagacaacaccgacgccctcgactgccgcctttgctgcctaccactcaagccgcccatcttccagtgtaaggtggggcacgtggtatgctcgccgtgccgagacaagctgggggcggctcggaggtgccatgtgtgtcgcacggcgacttccggcggataccaccggaaccacgacatggagaagctgctggagtccatccgggtgccttgctccaacgccgcctacggctgcgccgccaagccggtctactatgacagggacacccacctccggttgttctgccagcacgcgccctgccactgcaatatagaagcatgtggcttcgttggctcgacattatcggcgctccttgaccacgtcttcgccgtgcatgttgaataa

SEQ ID NO: 41 - DNA, 2553 bp, Lolium perenne
atgtcgacaatgaagggcgtcgacgacgcgttcctcggcgtcggcgacaagccagggctggacatctggtgcattatgggcaccagtgtagtcccaattgcaaagaatttgcatggcaaattctacactgggaactgctatattgtactcagtacagctgagctcaagaggggaagtcggcaacacagtgtgcattactgggtaggggaagaagcgaaagaggaacactgtgtgatggcttccgacaaggcctttgagttggatgcggcactgggctcccaagctgtccagtacagggaaatgcaaggtgaagaatctgacaagttcttgtcatacttcaggccatgcataatccctgtgcaaggcagcttctcttcgcactggagaagatctgcggaggaatgcgaccagaccacaatgtttcggtgtgaaggagagcatgtagctcgtgtcacagaagttccgttttcgcgtacctccctggatcataaggcagcgtttatagttgacactccgttgaagatcttccttttcagcggttgtaattctagtgtgaaaacaagggcaaaggcattagatgtcattaagtacctgagagaaaaccgacattccggtagatgtgaaattgggacaatagaggatggaaagcttgttggtgattctgatgctggtgagttttggaacctgtttggaggctatgcacctattccccgtgatgtaccagatgcagccaatggggagctgatgactaccacatccaagaaacttttttggattaataagagaaaacttgttcctatggatgcacacttgttagatagagaaatgctgaagtctgacagaagttacatactggactgtggaactgaaatatacttgtggttagggatggcaacactggtttcagagaggaagatatccattactgtcttagaggattatgtacgaagtcaaggaagatcatcaattggtcaaactgttataacgactgaaggtcatgaaattgccgactttaagctgcagtttcagcattggccgaagaatgtcgtccaaaagttatatgaggcagggagagagaaagtggcagcaattttcaagcatcaggggtatgatgttgcagaaattccagaagataaacctcaacagtccatcagtagtaatggttctctgaaggtatggctggtggaccgtggttctgtaaccctcctttgcactgaggagcaggaggaactgtataatggggattgctatattgtacagtacagctatgttgaagatggaaaagattataatctgttcttttcttggtctggacaaaatagcgtacaggaagacagacttgcttcagtttcattgatgtcaagcatgtctgattcagtcaaaggtcctgcagttgtggggcaagtgtctgaggccagagaaccagagctgtttttcctagtattcaagtccttgatcatattcaagggtggtaggagtgctgcatataagaactctgttctgcagaaaagcaatagaactgaagggtaccagaaagacggggctgcattattccgggttcaagggctgagacatgattgcgcaagagccgttcaggttgatctgattgcaagctcgcttaattcctcgcactgctatattttgcaagacggtccttctttctttacctggactggaagcctttcttcaccaactgaacatgttatacttgacaggatgatgaataagttgtttccactaaagcaatcgtttctattaaaagaaggttctgaacctgatcacttctggaaaacattagaaggaagatcagagtactccaaagagaagtgtgtcaagagttggccggcagatccacgtctgtatacctgtactttccagcaatgtctgttcaaggcaaaggaggtatttaccttctgtcaggatgatctggcaactgaggagaccttgatactggactgcggcgaggaaatttatgtctgggttggacttcactcaggtgtcacgtccaaagagcatgccctcgacatcggcaagatgttccttcaggcaggcaatgctgaggatgggcgacggtccatctttgacacaactgtttatgctgtcgcggaaggggatgagcctgcatttttcaccagcttcttcaactgggataactcaaaacaagttgcatccgttctgggcaactcatttgagaggaagctggcgatactgaaagggatttcaccaaaactggaggcaccggacaggagcttgcgcagatcatcctcgagaaggccagggacatcgtcggagccgaccacgccggaacagcaccagccagcagcgaggaggacgttcggccctgcctctgcctctgtcgggagggtagccaaggagagatcaggagcatctccggcactgtcgccgtcgccggtaacaccatcctggtcttgcgaggagccgcgcctcgtcctcgccgtcgtcgccatccacaccgttggtagcgcggcggctcttcccgtccacgctgcacgccccctccgctacagccactgcgagccccgctcgacgacg

SEQ ID NO: 42 - DNA, 1881 bp, Lolium perenne
atggactatacctcggatggagattctgagcttgaagcttatgggtcagacacttatgcacttctgctgtcaggagatatacaagtgatgaatgatgagggcttgtacaaatgccccttttgttcggatgaaaaggatgactataacaaatatgatttactgcagcatgcccttggtgtgggggctgcacatgatcagcaagtgaaagagaaggtagaccatcgagcccttgccaagcatttgaaggatgatgaaccagctaaatcccatagcccactcctgcagccaattgttatagatccacagcctcctcaacataacagagatgacctgtttgtctggccctggatgggtatcatagtcaatatgccttctgaatatgttggaaaaagtgcaaaccggctgaaggagcatttctcacgtttttatcctgtgaaagtgcaccatgtgtacagtaaaggtcgccctacaggaaatgctattgttgagtttgggaaggacttggttggttttagaaatgcactaacatttgagaatcaatttgagaaggaagggcatgggaaaataggctggcaggaaaaacagcatggagggccagagccttttggatggatcgctagagcagacgattacaatgctccaggagcaataggggactttctaagaaaaaatggtgatctgaagacggctgacggtgttgaggatgaagaaacaatgaaaaataacaaacttgtggccagtttatcttttaaagttattgaaactgatatgcatatacaagaacttaaatctgtgtatcaggagagaactgcatcactgaaaagaatgatggagcagagggaacagcagctacagtcatacaatcaagaaatccaaaagatgcaacagctttctgttgaacacacaaaaacgattgttgacgagaacaagaagctaagcctggatcttcagtctatgacgcatgagcttgatgcaaggtccaaacaaattgatgagttggctgcacagactgattgtgacagaaaaaaccttgaattggagaagcaaaggaatgcaatgaagttcaatcatcttacgctggcagaacgggagtatcagaaagctgatgaaaatgttctaaagcttgtcgaacaacacaagagagaaaaagaaactgctttaaacaatattaagaagttgaacgaaaagctgcatctgacgcacaaacttcaattggatataaagcacctgacgggaaaattggaagtgataaagctcacaccaggcaatgaaacttcagaatcggggaaaagaatagcggaactgacagaggagctgcgtgataagatcgaggagatggattatacagaaaactacaaccaagatctaatcgtacaagaaaaaaagactgctgttgagttgcaagaagctcggaaactggcgatagatgcaatacagcgttttcctggccagaccattgacaaagcacacataggcatcaagatgattggtgagcttgacttgaaagcattttcaaatgtgtgcaggcaaaaatttccaaaagatgatgctgaagttgaaagtgttaagctttgttcaaagtggcagaatgaaattagcaatccaaactggcatccttttgtggctgctatgttgaacggaaaagagtcggaagtgatcagggaggatgacaagaagctccaggaactgaaagaggagtacggtgaggaagcctatgctgcagttacgacggcgctgaccgagctcaatgagcacagtagcagcggcagcagggttcctttccccgagatgtggaactacaaggaggggaggaaagcgaaaacaaaggaaattgtccagcatgtcatcaagctggccaaggcgagcaaaagggggcgttga

SEQ ID NO: 43 - DNA, 252 bp, Lolium perenne
atgatcggcatgattgacgggcggacggagctgaaaccggcgccggagacgtccgccggcgacatgaggcagctacaggtgctcaacgtcctggtctccggcgaggtcgccgacctggagagcgggtacgtgacggacgggacgcccctcatcgtgcggacgtacctgatcctcgagatcaccgtcatggcggccaagatcgcctacgagaacgccgccttcgtcgagaacgtggtcaacaatgtctggaag

SEQ ID NO: 44 - DNA, 1296 bp, Lolium perenne
atggcggagctgaattacattcccaaccgcgtggcacaacaactggcgggcaaacagtcgttgctgattggcgttgccacctccagtctggccctgcacgcgccgtcgcaaattgtcgcggcgattaaatctcgcgccgatcaactgggtgccagcgtggtggtgtcgatggtagaacgaagcggcgtcgaagcctgtaaagcggcggtgcacaatcttctcgcgcaacgcgtcagtgggctgatcattaactatccgctggatgaccaggatgccattgctgtggaagctgcctgcactaatgttccggcgttatttcttgatgtctctgaccagacacccatcaacagtattattttctcccatgaagacgagcaccgtcatgcactgggacgcagattagagacctggaaagatgttgtcgccgtcctcgccgccgtcgaggtagttgaacggcgcgtccccctcgtagcggaagtccgggccgacgtagcacttcatctcgtggaacaggttcaggttgtccaccagtttgtggaaaatgttgcagccgcagcactgaacgaagacggtgccgtcggtgtaggcgtgcgggttgatggcgcgggtggtgcgctgcccgcacacgttgcaggtcgatgcgtgcggggagctggcattgttgaagcaggggatgcagcagagcttgtctttaaggctgcaacatcactggactctgttctgtggactacgatgatctcagcttatggaaagtctggccgtgcgcaagatgcagtatctatgtttgatagaatggcacatttgggcataaaaagagatggagtagcataccttgcggtgttgtcagcttgtagccatggcggacttgttcgggaaggttggcactacttcaaggttctgtttgatggccagagctcggttaagctgcagcctgagcactacggttgcatggcagatcttatttgcaggagaggttgcctacaagatgctcttgaattcattgagagcatgccatttgactccagtgttgctgcctggagtgcattgcttaattcatgtcgaatctatagggatgctaagttgggtcagcttgcagcatctcgtctactcaagcttgatccggggaaccacagtaactgggttgctctatcaagtatacatgctttggagggagattggcatgagacctggatgatcagggagaacatgaacaaagagtgggtaaacttcttcttcatcatcatcatttctttttacagtacagccatggtgattacatacatggcggcgagatga

SEQ ID NO: 45 - DNA, 2075 bp, Lolium perenne
  misc_feature (400)..(474): n is a, c, g, or t
  misc_feature (603)..(638): n is a, c, g, or t
  misc_feature (1091)..(1148): n is a, c, g, or t
  misc_feature (1263)..(1280): n is a, c, g, or t
  misc_feature (1536)..(1536): n is a, c, g, or t
  misc_feature (1666)..(1696): n is a, c, g, or t
  misc_feature (1908)..(1908): n is a, c, g, or t
ccgccccacgagcctccacctaccggccccgtcgccgtcgccgtcgccgcctccaacatccgcccccaaaaccctagccccgccacctccacagccgccccacgccatggccaccaacggcagctccccgagggttagagacgcggagagcagcctggacaaggtgaagcggcagctgtccacggggtccgggaggtacctgctgcagggtcccctgctgaaacgatctgagacgctacggaaatggaatgaaagatggataatattggacccaacatctggaaagatggaatacaaacttcggaggaatgaaactgctgtgaagggatccattttatttgatgctgcaagcaccattactttgtctcctgtaaattttcacggaatgccaaagtatgannnnnnnnnnnnnnnnnnnnnnnnnnnnnnnnnnnnnnnnnnnnnnnnnnnnnnnnnnnnnnnnnnnnnnnnnnntccttgaacacaaactttgatttgcatattctttctaagttttgaagtttgtttaactaacacttcaaacctcgcagcgggatgccaaagtatgacggctgctgtttctacattggaactcctcagaannnnnnnnnnnnnnnnnnnnnnnnnnnnnnnnnnnngattactttctttgcgctgaaactcctggtgctgccaaagcttgggtatctacattgcatgcaacacagttagtactacaagcacataaagaggcagtaaattcgttggctgggaatggctctccttctacattaggcacggttgcgacggcagttgctaatgctaacgcaactgctttggaggccatgaaggaggtagatgctgcactgaaggtttcaatgagggcagctcttgggttgggtacaaataatccaaatgagggtcaacttgatgatttaaccatcatgaaggagacgctccgagtgaaagatgaggagttgcagcatttggctaaggacatccgtgctcgggactctacaattcgggaaatagcagacaaattaacagagactgcagaggctgcagaggcagcagcttctgcagctcatacactggatgaacagagacgactnnnnnnnnnnnnnnnnnnnnnnnnnnnnnnnnnnnnnnnnnnnnnnnnnnnnnnnnnnggaagctcatatgtggcgcactgaactaggaaaagctagagagcaagcggtgatacaggaagcaactattgcacgagcagaggagaaggtaagggtgtctgaagcggatgctgcnnnnnnnnnnnnnnnnnncgttcggataaaggaagctgctgaaaatttgcatgctgttgagaaagaaaaggaggaacttttagcccttattggtgttctccaatcacaagtgcagagagaccaaagcagcacaaaacaagtatgtgaagagagatctgaatcatgctctggtgccgacaactcccctccattgacaaagcacgtcgatgcatcagatgatgatgtggacaaagcatgtgtaagtgattcaagatcagtcctggtttctagcgantagcaccgaagtccagcttgctgtggatggggtggacatccgtccaattggcgatgcagaatggggtgacttccagcggccagaagcattgatcgctgatgtccgggaagtctccccggaaggagaaggnnnnnnnnnnnnnnnnnnnnnnnnnnnnnnnccaccagtccctgatcatatgcagggaggggcaacacatccttgaaggtcttggagctcccacatactttcttggggggttgtgattattgaggaaactgccaaggatttgaatcctctcgagaattactgtcgcaggtttttgcactgcttccgggttgtatgtccattgtatttaagtatgcaactcaataaaagatgttacgggtttgnctgtgtgattgtaaattgttcacttcatctccttctgccatcatctggctttcagttcatgattgaaactgcgatgtgaaagtctgtttggaagttcagcaattagatatatctctatggaacaaaagaaaaagtaaaagttgtgcctgtctcgtttggatgctcct

SEQ ID NO: 46 - DNA, 2157 bp, Lolium perenne
atgctgcacgagctcctcctcgccctcctcggcttcaccggcgacttcgtcatcgacaactcctcctcctcctccgcccgccgccggccctctcccgccgaatccgtggccgccggagacgcggacgcgggccccgccttccgcctcgcccccgacctcaccttcctccagccttccgagaggagcgctattgaaaggctcatttctctgggcttttactatagagaactgaaccgttttgcaaccgagtctcgagatctgagctggattcagtcttctgtagatgtttcatcacctaatgctgatataactctgaagggcaaagtgagaaaagggagtgcataccggagagcaattggcaatggtattgccgagattttatcagtttataggtcagctgttctgcaggttgagcaaaacctattgtctgatccattgcctatcctggcgacagtaacccatgggctaaataagtttgaggttctcctgcctccactttatgagcttgttatggaaatcgagcagaaagacatcaagggaggacagcttcttaacctgttgcataaacgatgccattgtggggttccagaactgcaaagctgtattcagagacaggttgacagggatgaggagaatgaatcagctcagtcagatgttgctgataagtttgcgcagaaattagctaaagacacatccctgactagttggcattcaggatttcatgtatcattggacatgctacctgagtatatccacatgcgagttgcagaatcaattctctttgccggaaaagcaataagggtccttagaaatcctagtcctggtgctacattgcaggaacctgctaaccaaagtcagatcttgaaaggatctcatagaatgcaaactttcacagggggttccggtgctctgaaggagctaccaaacttctctaacattagcgcagaagaattattaccccaagttgaagcagataaagttgatgcgatgctcaaacagctaaagcattcttccgagttccataaaaggttgtttgagtctgctgttagctcaatacgaacaattgcagctaatcatctttggcagctagtggttgtacgggctgatctcaatggtcacttgaaggcacttaaagattatttccttttagcaaaaggtgattttttccagtgttttctcgaggaaagccgtcaattaatgcgcttaccacctcgtcaatctacagctgaagcagatctcattgttccttttcagttggctgcgctgaagactataggtgatgaagacaaatacttcaccagggtatccctaaggatgccgttgtttggtatgaaatcaagcacctcgcagaaagatcttcaaaagtccaatactccagatctttcctctcaaggaaaagctagctcagagttggcacttgatggatggcatagtattgctctagaatattctgtcgattggccactacaactcttctttactcctgatgttctttctaagtatcgcaaagttttccagtatctcatccgattgaagaggacacaaatggaattggagaaatcttggacagctgtaatgcatcaagatcatgttgatttttctgattattgcaaggatcggaaaaattcttctgcaacccaactgcgccggttacgcactaagcctttctggcgagtaagggagcatatggctttcttgatcagaaacctacagttctacatccaggttgatgtaattgagtcacaatggaatgtcttacaaactcatgtacaagattcacacgattttacagaactagtgacctttcatcaagactatttgtcagcgttgatttcacaatccttcttggatataggatcagtgtccaggatactggacagtataatgaagctctgcttgcagttctgttggagtatcgagcattatgaaaccggcgcaaacatgtttgagattgatcacataactgaggagttcaacaagaaatcaaattcgctgtacactatcctaaggagtagtcgacttgcggggagtcagagagcacctttcctcaggcagttcctgatgagactaaacttcaactctttctttgagacaactgcgagaggggtgatgaactcgggcaggcttcggccaaacacagcgggcacccagctataa

SEQ ID NO: 47 - DNA, 2457 bp, Lolium perenne
atgggccagcaggtgtttgcggagcatccacctgtatctgcggcaccaggggcacatccttgcccgtatgttgcgtacttgcaacctcttccatcattggcctcatcatcaagcgcccatgtccctgagagaactatggatgggtctgtgtatcatgatcattggaatcacctggctggcccatcagatgggaggcccttgcacacggtgccacccactgatttccatcataaccattgggcacatctgccgcattcctatgcccaacccaacagtaataatgggttgactgagcagccaggggtccctttcggaacaatgagagctgcaagggctgacggtgatatccaacgccgagggtctgttatttctccatcatacttcagcaatggatctggctctagatctagagctcctaatgttccccctctggtacctcaattcatgagggggcatggcaacatcaacgagcagtaccagcagaatccatcatctagcctttttgcgggggctcatagatcgggaggcatgcgatctgcccctccacctcaaccagagaacccaacattttgcctgttcccgcctggttcgtctggccatagttcaatggagactgatgacgctggaggaagccgattctacgcctgggagcgtgatcgcttcgcgccatacccattaatgccagtcgactgcgagacaagctggtggagctcgcagcagtctcacggggcatcagaatccacagcagcaccagcaccagcacccgcgccgaggagactattcgggcaatggatcggtctcggcaggggcgccgccactctgggcatactgcaacagctgcacccctggcggatgatccccatgatttccatctatgctgaagatatcatggcgatcaaagagattctcaatcttttttggcgtacatcagggctacaggtgaacttctcaaagagctctgccacccttattcactgcagtgaggaagacaccgatgccatcggccaacactttagatgcccatctgtgcaattccctatcatctacctgggcatttcgctcactgcccgcaaatcaacagccgcccagatgcagccgctgattgagaaggcgcgagacaatctaccaacatggaaggcacgtcttatgaacaagtctggtcgccttgagcttatcaaatctgttctcagtgcaatacccatgcatcagctgcttgtccttgcgccaccgaagaaaagcaccaagcaattagaaaaaaatcgagcgtggatttctctggactgcgatctggagcgcgccggcctcactctgcgcctccggtggctctggtatagccacaccgacatgaacagggcctggagcaaccttgaactccaattctcggcagaagaacacaccctcttcttcacttccacttcgatgtcagcgggcaatggccagaccgcgctgttctgggacgatcgctggatcagcggccgctcaatcagcgagattgcaccacaactccatgcctgcagaccaaaaagaaggtggaaagcccctgagacaatgctgcgcctgaccctgccctgcccttccaccttgctgatctggcaggaaattctctcatggcaccggatgacctgcagaccaccagcccaggagatatccctcactgaatggtggatagaagcaagacaacgcctggcccccgcgacgctgctcatcctgtggatgacctggaaacaccgcaacagttgcgtgtttgagggtgcacaacctttgatcaatggtctgatctccagcatcaaagatgaaacaattctctgggctaaagccagtgccactggcctaggagtagtgaccgatgacctgggatgtacattagttagttttcctctttttttttcaagaacccgcaggaaatctccgagtcatttcattaagctcgaaaaggagggttctccatgggttattctaaatcggcggtttatagagtattgtattcttggctgggagaatcttcctcgggttcttctcatgtacttcaacaacgtagtgctgcctcaggaaggatacttccactcagtcatatgcaactcggttgatttccgtaattccactgtgaacaatgatttgaggtacaaggtgtgggatgaaccacctcagacagagcccctatttctgaacatggcacattatgatgagatggtgaacagcggacagccttttgcaaggcgttttcagaagaaggaaccattgctggacaagatcgatgacaaactactcaggcgtcctgggcatgggcctgttcctggtgcctggtgctcaggcaggaagggctggttcgttgactcatgttcccagtggagtgacgtgaacgttgtgaaacctggtcctcaggccttgaagttgcagcaatatatcaatcggacattggaagaagcaaattctggcgcaaaatcatgcaggcgatag

SEQ ID NO: 48 - DNA, 1224 bp, Lolium perenne
atgaaggtccatttctcggcgaagctgctatccggcccggtgccggtctacttgctggcgctggccgtcctcatcctcctcacccacgcgcactacatggggcacgtcggcgtcggcgtgccgcccgccgccaagctggaggagccggtggtgagcgtgatgaagcagtgcgacatcttccgcggcgagtgggtgccggacacggcggcgcccgcctacagccacaagacgtgcggcatgatccaggagcaccagaactgcctcaagtacggccgccccgacctcggcttcctcaaatggcggtggaggccgtcgggctgcgagctgccgcggttcgacccggcgcagttcctgcgattcgcccgccacaggtcgctcgccttcgtgggggactccctggctcgcaaccacatgcagtctctgctctgcctcctcgcgcaggtcgcgtctcccaaggacatatcgccggatccatcggaccagcagaacaaggtgtaccactacagggcgtacaacttcaccgtcgccatgttctggtcgccgttcctggtgcgggcgcgggagcccgcccacgacgaccccgcgcacaccgcccactacagcctctacctggacgagccggacgagaggtgggtgtcccaggtccccaggttcgactacgtgctcgtctccgccgccaactggttctcccgcccctcgctcttctacgagaagcgccgcctcgtcggatgcagcttctgcagccgccagtacggcgtgccggacctgacactgcactactcgcaccgcaaggcctggcgcgtggcgctgcgggcgatcaacgccctggacaacgtcacggggcgggtgatcgtgcggacgctgtcgcccatgtcgcacttcgacaacgggacctgggaccagggcggcgactgcaggcggacggagccgctccggagcaaccagacctccatgatggacggccggggccccgaccaccggttctacgcggcgcagatggaggagtaccgggcggcggagaaggccgcgcgggccaaggggacgatgcggctcatgctcatggacgccaccgccgcgatgctcatgcggccggatggacaccccagccgctacggccaccgccccaacgacaaggtgcagctctacaacgactgcgtgcactggtgcctgccagggcccattgacatctggaacgacatgctattccagatgatcctcgtctag

SEQ ID NO: 49 - DNA, 5064 bp, Lolium perenne
atggcccccaaggccggccgcggcaagggcaggggcggcggcggcaagggagaccgcaagaagaaggaggagaaagtggtgccgaccgtggtagacctcacggtaaccaccccctacgattcccaggtgacactcaaggggatctcgacggatcgcgtgctggacgtgaggaggctgttggggtccaacgtcgagacgtgccacctcaccaattactcgctctcccatgtggtgcgtggtcatcggctggacgacggcgtggaaatcgtggccctcaaaccatgcgctctgaccatcgccgaagaggagtacgcgacggaggaggccgccgtggcgcacgtccgccgcctgctggacatcgtcgcctgcaccaccgccttcgccaagcacaagcacaagtcctcgcccaagcacgcgcgccccgcgacgcccccgtctccgcccgccacagcctcctcccccgcggccaatggcggcaaaggcgacggtgccgaggcgcctgcgatatcggaggcgcacgacatggcggccatcgggccgccgccgaagctcggcgagttctacgacttcttctccttcgcgcacctcacaccgcccctccactttatcaggaggaaggagaagaatggtgctgcccaggaaggcgattacttcgaaatcgaggtgaaggtctgcaacgggaagcttctgcacattgttgcttcggtcaaggggttctacctggtggggaagccgcacaccgcgtacgaggcactgatgaaagcttttgtggatcacaacaagttcgggaatctgccgttcggcttccgtgcaaacacatggcttgttcctcctgtatacatggactctgctgcaaagggcccagcgttgcctgttgaggatgagagctggggcgggcatggaggcggcagaggacgagacggaaagcatgaccggagacggtgggcaaaagagttttctattttggctagaatgccgtgcaaaacggaggaagagagggtggtcagagaccgcaaggctttccttttgcacaatctgtttgtagatacagcgattttcagagctgcttcgacaatacggcggctgattgataccagtgtgcgaactggttctgatggttcgttagtgtttgaggaacgcgttggggacatgcatgtaactgtaaagaaggacgatgctgatgctagtgtgaagttgggggataaagttgatgcagctgccgtctaccagacggatgctatggatatatctcaaaggaatcttcttaaaggtttaacttctgatgagagcgtcgtcgctaaggactcttccacgctaggtgtggtgattgttaagcattgtggatatacggcaacggtgaaggtttcgggtcgtacaaagaatagcactgatagcaaacaacccagtgatatctctgatcatcttgatggagtgctgaacatcgatgtagatgatcatcccgatggaggttccaatgccttgaatgttcacagtctaagaataccactgccaaaaattattaacccagaagtggctgccagtaaccagcaccttagctctaagactcatgttgataattatgcgagaaaactagcacgtacagtacttgaagccagcttgatgaagctggagaacatgcagaaagaaaatcctagacttatcagatgggaacttgggtcgtcctggctgcaacatttgcagaaaaaggattcttcagcttctggggatagtgagaagagcaccaaaaaagttgaaaaagattcatctgtcaaaggtcttggcaagcactttgaacaattaaggaaacttaaaaagaatgttgaaggtgctaagactgagaaggaagactctgatagcaactgctcactgacaaatggtatggaagaatcagataataaagcatttgacgaaaccagtgaggctgaattaaggaagctgatgacagaagatgctttctgtcgcttaaagagtttggaagctggccttcatcaaaagtcccttgaagagctcacaaagatggcccataagttttatgatgatactgcactcccgaagctggtggccgattttgcttctcttgagctttctccagtggatggaagaactatgactgatttcatgcacacaaggggacttaatatgtgctcattaggtcgtgtggttgacctagcagagaagctcccacacatccagtcaatatgcatacatgaaatggtcattcgatcctttaagcatgtcattcgagctgttattgcaagtgtcgatgacatgcaaaatatgtctgctgttatagctgagactttgaacattttattgggatctccaagattagataatgatcttgatacagatgcccataatgagcataacttacgactgaaatggatagagagcttcctatctaaaagatactgttggaaattgaaagatgaatatgaacacttgcggaagtccatcattttgagaggcctttgcagcaaggttggccttgagttggttgcaagagactatgatatgaatagcccaaacccgtttgacaaatccgatattgtcaatatagttcctatatgcaagcatgtcgtttactcatctattgatagtaggaacttactagaatcatcgaagatggctttggataaaggaaaacttgatgatgctgttaactatggagcaaaggccttgtccaaagttatagcagtttgtggtccataccatcggctaactgctaatgcctacagtcttcttgctgtagttctttaccatactggagattttaatcaggcaactatatatcagcagaaggcactcgacatcaatgaaagggagctaggtcttgaccatcctgaaactatgaagagctatggggatttatctgttttctactaccgtctccaacacattgagatggctctgaagtatgtcaaccgcgcactttatctacttcaattttcttgtgggctttcacatccaaattcagctgccacctacataaatgtggctatgatggaagaaggtatgggaaatgttcatgttgctctaaggtatttgcatgaagcgctgaagtgcaacaaaagattgcttggagctgatcatatacagactgctgcaagctaccatgccatagccatagccctctccatgatggatgcatactccctaagcgtgcaacatgaacaaaccaccttacagatacttcaggagaaactaggagaagatgaccttcgtactcaggatgctgctgcttggctggagtatttcgattcaaaagcattagaacagcaagaggccgctcggagaggcattccaaaacctgattcttctattgcaagtaaaggacatcttagtgtatcagatctacttgactacataagcccggaccaggaaagaaaagagagggacatgcaaaggaagtgcaggcgcgcaaagaataataccagagcccaacaaggtgaatcagttgaagaaaaggagaacttccaggatgactcaggatctcttcttgaagcagtcaaaaatgatttccaagaagcaaaactagaaccgcaggctcctgttgtatcagtagtaacagaagaaatttgtgcagtccatgatgagctgaagcaggtagaggctttatcacctgaagagtattctgatgagggttggcaagcagctactttaagagggaggtctgcaaatgtgcggaagaaaagcatccgcagaaggccagctcttactaaattagcagttggtcgcatagaagatggccgcactgcttctgctcaaaggactgatgtacagccacagacaaaagagcataaagaggaagctacatactcccctagccaactatcatttggcaactttttcaacagtgacaagttgaatggtgatcccgtccttactgaagacaagtcttgtaatgctacgtccaaatcagaacagagcataaaacctacaggaattaacaggccaactagcatagcttccaagttggtatcatacaaagacgtggcagcgtcaccgcctggcacagtatggaaaccaattttggagcagaaggaagcaaaggagaaggatactgaagaagttattgatgtaacaccttcgtccgaggaagatgggaaggttacagatgaagttgagaagtcgagtgatgagggaagcaaagagattgtctcaagtcagccagagggaggcagtcattcagagaaagcttctgacagtgacggaagcacatctccgaacaagaaaacaagtggaagcaaactttcagcttcagcacctccgttcaatcctggatcactcttatcagtttcccatccttacagcacagtagcaatatatgatgctagtgttgttcttcagacaatcccaagtcaggcaatggagatttttcctcatgctgttgatactagagtgcctcgtggtcctcggtccaccttgtactaccgtactgggcattctttccaaaggaagcagggttatacacagagccagagcaccattgtgagaggtagcacctcccctccagccatgaatccccatgctgctgagtttgtgcctggaaaggctgtgcaacaaacggatttggctaatgggaaacatgtggccgattcagcggatcagcagttgacgccgcagacctcagatgaagtgaaagccgatattcatgctgcagacaaggcaggccaagtggagaagataactccaggtaaagggaaggaaaaccgagggaaagatgcgatgagagattcgtacaaggcagagctggcaaggcagatcctgctcagtttcattgtcaagtcggtgcatgacagtttaggttcgactcgagctcagccagacagaaagccaagtgcaccggatgaaccaagtaacgaacagagcagcaacataaccaagcccgcttcagctcgcaaggagttcgataaacaacccaaggcagctgaggtgctgaaaagcgagaaggatacagagggcttcacagtagtttcaaagcgaagaagaagcaagcaacacttcatgaaccccataaatggtctctactctcagcagtccatctgcacttcggtcagctga

SEQ ID NO: 50 - DNA, 621 bp, Lolium perenne
atgtcgtcgtcctcgtctcgccctccgacgacgccgaggggcgctgcagcggcggcggcgggatgcgcggacccgaacacgacgttcgtgcaggccgacccggcgaccttccgcgcgctcgtgcagaagctgactggcgcgcctgggggagcgccggcggcgtcggtagagaagcagcaggtttctggcactatcttcccggcggtgccgctgcctttgaggcggccgaagctgcaggagaggcggcgcgcggcgccggccaggctggagctcgcgcggccgcagccgttctactaccaccctcatcatcacaaccaccaccaccaccaccaccaccacggcatcatgcagtactcgccggtgtcgaccatggactacgcccacgccctggcggcctcctcctccgcctcttcgccgtcaccatcgccgcactcgtcgtgctcctgcggggtggtcataagcaaggaggaggaggagagggaggagaaggccatcgcctccaaggccttctacctgcactcctcgcccaggagctccgcggtcgccggaggcgactccgagaggcccaagctgctgccgttgttccccgtccactccccacggagctcctccttcgcctag

SEQ ID NO: 51 - DNA, 681 bp, Lolium perenne
atgtcctcggctccccctcctccggcaccgccttcgcggtcgtctaacccggaggcgccgccgcgtgtcgtccgcccgccgccgaggcgtcccccgagggcgcccggaccgccgccgtgggctgagcggcggccctctgtttccgtcgactacgaccgcggccgccgcaccgcccgggtcgaggtggacggcgtcggcgccgacgcgcttccctcgcggcaccgcctgcgcgtggaggggagccggtggcaacgggactggaaggtgtcccaagttgccgcgcgcgtgctcgcgctcccgccagccgacgcccatgccgtcgacgccgtgctcaactgctgggccgggcgcttcgcgcgccgtaacttcccgctccttattcgtgaaatcacatttaccgggtccttgcaacacgctgtacatgtgttccgctggatgaaaaatcaggagaattactgtgctcgtaatgacatttacggtatgatgatacgattacatggcagacacaatctggttgatcaagcacgtggcctcttctttgagatgcaagaatggcggtgcactccagatgctgacatattcaactctctaatccatgtgcatgctcgggctggtcaatggcgctgggccatcaacattatggatgatatgcttcgtgctgctgttagtattgttctttga

SEQ ID NO: 52 - DNA, 864 bp, Lolium perenne
atggacagggggcgaggtagcgatgaaatgataccaggggtatttttcgtcgggcatgcgtgtctggaggtggccgcccccgccggtaggacgtttgacctggggacgccggatctggaggctactgaccggatcttgaggacggcgccgccgccggaaccggaggctaccggtcggacctgcaggggcgacgccgggcctgaagcagacgtagatgtggccggccgagccctggccgtggttgagcgcgacggcgcgcacgacccggccaccggccgcgcgctcaccggctcctggctatgggactccgcgctcgtcctcaccaaccacctcgcctcggccgagcccagtcagctcctcggcgccaccgtgctcgagctcggcgcaggcacgggcctcccgggcatcgcggccgtcgcatgcctcggcgccgcgcgctgcgtgctcacggacgtgcggccgctcctgccgggccttagagccaacgccgaggccaacgggctcgacctcgacacggcgcaggcggacgtgcgggagctgcgctggggggaggagtatgacctggtaatgctcgatcgtgaggtcccgtgcgtggacgtggtgctcatgtcggacgtcttctacgacccggaggagatgccggcaatggctaccacgctgcggcggctgtggcgggacggcacggtgtgttgggcggcgagcgaggtgcggtgcggcgtgcaggactgcgtggacgtgctgcgggaagaaggcttcgacgtggccgaggtcgacagggtcaccaggccgctgctgcgcgccccctcgcagaacgccgacttcgccgtgtatcgcatcgaattacggcggtctcgagagggctga

SEQ ID NO: 53 - DNA, 1245 bp, Lolium perenne
atgggttccagcctcaagtaccgcgccgggctcgtcctcatcggcgccgtcgtgctcatatgggtcacctccgccgaggtcacgcaggagatattcgctgactacaagcaaccgttcgcgatcacttacttcggggcctcccttatggtcatctacattcccttggcgtttctgaaggatttcatatacaaattgttgagaaggcattctggaagcagcagagcgtcaaaagtcgtgagcaaatcttcctttggcggcagcgctcctctgaagaatggtgaatttgagaagatgctggaaatggaaccgcagaaaaccgtggtcatagattttactgatgtggacatccctgtgctagaagaggcaaaaccgcttatttgtggaatcggtgagtttggtgatgatgttctgaaggagcaacagctttccaccaaggagattgcaatttacggattatatctttgccccatttggtttgtcacagagtatttatcaaatgcagcccttgcaagaacaagtgttgccagtactacggtactatcttcaacttcgggactcttcacactcttcattagtgtgctccttggccaagattccataaatgctgccaaagttattgctgtttttgttagcatggctggtgtagcaatgacaactatgggccagacttgggcaacagatgaatctgaagtaagcaattcaggaacttatcgccttgctaaccatctaattcttaagccttactactgcagggccacacagaggactcttctaggtgatatgtttggtcttctgtcagctgtgtcatatggtctcttcactgtgcttctcaaaaagtttgctggaggagaaggatctgaaaaggttgatgtccaaaaactgttcggctttctcggacttttcactctttgtcttctctggtggcttgtctggccattaactgcgctaggcattgagccaaagtttacaatgccccactcagctaaagtggatgaagttgttctggcaaatggccttattgggagtgtgctatcagactatttctgggctctatctgttgtttggactaatcccttggtggccaccttaggcatgtcactcacaattccactagcgatggttgctgacatggtcatccatggtcgacattattcagcagtctacattattggttctctacaggtattctctggctttgtcattgccaatcttgccgatcgcttttcacgttttctgggtctatag

SEQ ID NO: 54 - DNA, 1749 bp, Lolium perenne
atgaccagcccatccgcgccgccgccctgccctcacctcgccgcgcaccgcctcacctcgcgcccgctccgcttcccccgccgctgcctgcgcgtgcgtccgctcggccgccccgagatccgccgcgacgcgcgcgaggtgccccgctgctccccctgcgcgtcctcctccccgccccccgcccgcctctacgcctgcctctcctgcgcctccgtcttctgcccctcgcacgccgcctcccacgcctcctcctccccgggccaccagatcgcggtcgacgtggaccgcgccgagctcttctgcgccgcctgcggggaccaggtctacgacccggacttcgaccacgccgtcgtcctcgcccagtccaccgcgctcagccccccatccacctccaccccctcacccgctccccgcaagcgccgccgcgtcgactaccgcgcctgggcgccagatccggccgaatccgcgctggtcagcgcggccgccgatcccaccacttcagcgtccacaaccgatccagcgggcctgcgcgggctaaacaacctcggcaacacctgcttcatgaactccgtgctccaggcgctcctccacgcgccgccgctccggaactacttcctcggcgatcgccacaaccgattcctctgcccgcgccgcacgcccatgaggcaccgcgcgaccgatgcggacgccaaggccgcctgcctcgcctgcgatctcgacgagatctactcggccaccttctctggggagcgtacgccatacagccccgccaagttcctctataggtccggatctcaagctctatttgcattggttcatgtcgcgctgtcatttcagcagcctgctgttctattttatgctggctggtggcagcatgcaacaaaccttgcaagctacgagcaacaggatgcacatgaattttttatctccatccttgaccatattcatgaaaatataaaggatgatgagcacaaatcacatgaacaaggccacggagactgttgcattgcacaccgggtgttttctggtatcctgagatcagatgtcatctgcacaaattgtgggttctcatccacaacttttgaaccttgcatggacttctctttagacttggatgctggatgtaacggttctcgtggtgttgcaaacccaaaagcacgcaatggagagaggaacttagctggcatgaatcccaaggtatcatcaacactcatgagatgtttggagcggtttaccagggctgagaggctagatgctgaccagaagttcttctgtgaacgttgcaaggagaggcaagagtcccttaagcaaatgtccattcggaggcttccactagtttcctgctttcacatcaagagatttgagcattcgacagttaagaagatgtcaaggaaggttgatcactctttgcagttccctttttctcttgacatggcaccttacctgtcatcctcaattctcagaagcagatatgggaaccgcatatttccatcagaatccatagattcagaagcagtttcggaattgtcttcagaatttgaaatatttgcggtgatcactcatagtggtaagctagatgctggccactacgtgacttatctcaggttaaacaatcagtggtacagatgcgatgatgcatgggtaaccagagttgacgagcatactgtcaggacttcccaagcatatatgctcttctatgtgcagaagacactttactataaagcttgtgaaaagccagctgcagtctga

SEQ ID NO: 55 - DNA, 888 bp, Lolium perenne
atggtccgtgctctttcgtccagccccgtctcttcgttcgcaaacgcactccctggcgtccccgcccgcagatcacgccatggattgggccacccggaatcccagatgccgaacatcaatgacgaggacgaggacaccggccccttcgtacccaccgcacctcgccatccgcccgatcgatccatgcagccgccaactcccctcaaatcagccccacttggacgaggacgagggcaccccatcatgcccgccgcacctcgccatagccccatcatcctgagcttgacggagagccctaacggcgagcttgaaccccgccgtcgccgatgttctgtatccccgcgatttcgagcaggagaagcaaaccacaggctcacggtggaccgggagtttgaggatctggaggcgcactctggggcaacagatttagagtccggggctgatgaggaggatcaagatcaagccgcccaccgccggggctgttgccgctgctgcatggttccaggttcggcctcctcctcttgggctgctggtgaagcaaaaaatagtacatacggaactggtggcttcatccttctcaacacacgggacgaggttacacagccttcccatggtcttcttagcaccattgcttacaagattggcccatatgtaaccaccaattatgttctcgaaagctcaattgcaattgctggtccagtagttaagtggttgagagacagccttgaaatcattagcgcagccgtagaaattgaaattttggctggaagtgtgcaggattcagattcagggttcatcggagatggacttcttcaggatgctaacagatacaatattcaggaagtcatcaacaaagggaagttacaatgtcgtttgttcagacattga

SEQ ID NO: 56 - DNA, 1566 bp, Lolium perenne
  misc_feature (1415)..(1415): n is a, c, g, or t
atgaggtgtgaacttgattattactggtcactgggtgaagtctctgacaatgggggagtttcatgtgtcatctacaaagtccaagaacacattcgcatggctgacaagctctcttacgaaccttgtgtgctatcaattggcccttatcatcatggagctccagccctacagaccttgcagaaagacaaatggagctatttagattttattctgaacttgaatacagataaaaccttgcaggattacctacttgcacttgaaagcctatcaaaggtagcaaggagctgctactcggaggatatcgaaatggacgctgaggagttcctgcaaatgcttttactcgatgggtgctttgttttagtagctcttggaggaaccaaagaaattttggcagccgcaaaacatataaagttggacaaattgaagtctgaagatacgccagagaacatatctaatcccaacgatgcttttaatgggacagatgaaacaaataacgaaagtatgaaccaagaaggtggagaagatggtaaattgcaggcagaacaccgcactcaataccaagatgaattcgggcaatggttctatagatttttagttcatgatttgttcttgttagagaaccaaataccattctttattgtgaagaagatattcaatgtagtcgccagtgacaacatcttggatgattcaccgtttactcatgaaatatcgagatatgtggacgctgctttgcggtggtttccaaaatcaattcaagagtctgatatgccgaaagacttcgacaatttacttcagctgtgccacatgtactttcggccaagccgtacggcagaggattatagctatcaattaggaaagcaatatttcaacagatttttaagtttcggcctcaaatacttgaaaattggacagtatcatgacgatactgaagaatattcatcatacaatcttgagataccatacttacaagatggccagcagttgagtcgctggcgtcgagctgcacaataccttgaagctggagtcaagtttaagaaacgggagcatgatcaattgcatcctcattcactattagacgtaaaatttagcaatggtacaatggaagttccatgtattgttcttgatgagttcacgggggctctctttaggaaccttattgcatttgaacaaacttgtcctcagtttggagatgactttacagcatacattgttttcttatcccagctcataagtatgcctgaagatgtcacactacttgctcggagagagatcattgtgcatcatctcgacagcgacgaaacggtgtcagatctgttcaccatgctcagtaaggatgtggtctttgattttaatggtcagtattatctgaaatctttatgccagatgatggagacttactaccagagtcgtctgantaggtggatggcatggctttggctaaatcacttcagaaacccatggttggttttagctgcatttgccacagctgttgttctcgtatgtacagtagtacagacagtttatggagtactggcctacattcacccaccaggatccaacaagtaa

SEQ ID NO: 57 - DNA, 1173 bp, Lolium perenne
atgggcaggcgaggcggcgtgttgtttgtggtggggggaggagacggcgtggcgaggaggcgggatggggaggcggcgccgcgaggaggaggggatgggggcgccggggacggatgcgtgctggggagggggagcgatgggtttctgcgagaggagaatagtggaggcgggatcgctaattacatggtggtagactactacctgtatgactacgagtacgccgagccgccgcgcgtgaccagcctgcagaacgccgttccccagaggaccttcagcgacttcggagatgacgtctacttcgtcgccgacaaacggggctacgagtccgtcgtccactacctcgccggccagtacctcaacaccgacgactccggcaacgtcgccgacccccgcctgcagctcaacaaggtggtgcgagagatctcctactcctcgagcggagtcaccgtcaagacggaggacggctcagtgtaccaggcagactatcgtcatggtctctgccagcttgccatctcacacccaacacaccactctgctaactactcgatcatactcttgacatttgctatgtcgatcgacctgcaagcatggaaaatcatcgccatctaccggttcgacatggcagtgtacaccaagatcttcctcaagttccctcggaagttctggcccacgggcgaaggcaagcagttcttcgtctacgccagctccaggcgaggctactacgggatgtggcagtccttcgaggaggagtacccgggggccaacgtgctcctcgtgacggtgacggaccaggagtcgcggcggatcgagcagcagccggacaacaccaccatggcggaggctgtggcggtgctgcggaggatgttccccgacgaggacgtccccgacgccaccgatatctacgtgcccaggtggtggtccaaccgcttcttcaagggctcctactccaactggcccatcggcgtcaaccgctacgaatacgaccagcttcgggcgccggtggggcgggtctacttcactggggagcacaccagcgagcactacaatggctatgtccatggaggttatcttgcaggcacggattctgctgacattctgatgaacagtatcttcaacaacgtggagtttaaagtccgcggcaagtaccatgaccagaccgcagaggctaaatga

SEQ ID NO: 58 - DNA, 795 bp, Lolium perenne
atggccgaggccgacgatgccgcggccgcccgccgacgcaccgtggtcaccgactaccgcaacaagctcctgaactgccgcgagctggagacgagggtccgcacagaattagaacttgacagaggaaagaagagtgactacccagtatctcgatcagctagggagaacctaaaaaaggcaaagaaagattatgataaaacagaagatgacttgaagtctttgcagagtgtgggccaaatcattggtgaagtacttcggccattggacactgaaagatttatcgtcaaagccagcagtgggccacgttatgtggttggctgcagaagcaaagttgacaaagaaaagctgacagctggaacgcgggttgttcttgacatgacaactttaaccattatgcgcactctaccacgcgagattgtttcaagtgctatcattgacaaatatattggtgaaagtgcccgtcttataagagaaatgttcaactatgcacgcgagcatcaagtcaagatgattatggcgaccaaccgtcctgatgtcttggatcctgcactccttcgtcctggacgcttggaccggaagatagaaattccattgccaaatgagcagtcgaggatggagggcttcaacggtgccgatttgcgcaatgtctgcactgaagctggcatggctgccattcgagcagagcgtgactacgtcatccatgaagacttcatgaaggcggcggtgcgaaagctgaatgatgccaagaagctcgagtctagcgcccactacagcgcagactttggcaaggaataa

SEQ ID NO: 59 - DNA, 3264 bp, Lolium perenne
atgacaaagctcaagagcgtggcgtccacggtgggggcggcggaggagtgcgcggggagcgctcggcagattgccccgtcgccgatgaagctgctggtgcgcgtcgtggaggcgcggggcctgctggcggtgcacgtcaacggcaccagcgaccccttcgtcaagctgcagctcggcaagcgccgggccaagaccgccgtcgtcaagaagaacctcgcccccgtctgggacgaggagttcagcttcctcgtcggcgacgtcaccgaggagctcgccgtatccgtgctcaacgaggacaagtacttcagcaacgaccacctcggaagggtcaaggtgcccctctcccaggtcatggacaccgacggcctctccctcggcaccgcatggtaccagctccagccaaagagcagcaagtccaagaggaaatgccgcggggaaatctgcttgcgcatatccttgtctacacgaacgcacgtgtccgaagaactgcaccctctaccgcgccccacttcggacggcgtatcatccagttcagacaggtcaatcgggaccaagcgtggagctctgtcaaccaccaacagctacattgacctctcagccgtggccagcttggaccgaggatcgcagagcagcttcgaacggtcggcggatagcttcgtggagcagccgcccaggagcagcatcgaacaagcagtcaccgagcctggaacggccgctgaaactgatgcgatggccaacacgtcgtcgatggtagaggtcttgtctcgctatttctttcggaaacctgtcgacgccgctgtggctgcagttgtctctgatgccgagtcggtggtggatcagtccccggagccgaaagcgtgctctgaagaacgtgaaggtcctgagaatcgcacgccacctgagtcgagccttgatgagctactgaaaatcatggagtccaaagatcaaggcgctgaaatgccagctaaactgtctaatggcgttctggttgacgaatcttatgttactgcaccagccggactgaatacgctcttgttttctccaaattcagatttctggccggctgtagcagagcttcaaggaacaagtggatttcagattgaatcgtggaagatcgatagcaacgatggttgtttgcgaagaacattaagttacataaaagctgcgagtaagctggttaaagcttgcaaggccacagaagagcagaaatacttgaaagcagctgggaattcttttgctgttttgtctattgttagcactcctgatgttccttgtggaacttgtttcaagatagagatattgtactctataacgccaggtccccagttatcatctgaagagcaaacggcacaccttactgtaagttggcggatcaactttgttcagagcacaatgataaaaggaatgattgaaaatggggcaaaacaaggcatgtcagaaggttatgcacaattttctgaagtactgtcccaaaagtttaaagtagctgagcttgatgatgctaatgcaagcaaagcaaagattttggcttcactgcatacacaaaaagaaccgagctggaggctgattgtccgcttccttgggaacttcacattcatagtctctgttatcgtagggatatatattatagcacaccttcatttgtcaaagcccaaagcgatgaatgggcttgagtattttggcattgaccttcccgattcaattggagaggtcgtggtttgtgctgtgttgatccttcagggacagaatatcatgaaagtaatgaagcgcttttcgaatgcatggaaacaaagaggtagtgatcatggagtcaaagctcatggagatggttggatactgactgttgcacttattgagggcagtggtatagtagctggtgattcctctggcttatttgatctttatgctgtttttacttgcaatgcgaagaggaaaacaagctcaattaaattccacacctctgatccaaaatggaatgagatattcgaatttgatgcaatggatgatccaccatcaaggatggatgtggctattcatgattctaatcgatccgatggagatcccattggtcacgctgaagtgaactttctgacaagcagtttgtcagatttaactgacatatgggttcctcttgatgggaagtgtgatccagcaagcaaccctaagctacacttaagaatctttttgaacaactcaagaggaactgaagttgtcatgaattacctgtcaaagatggggaaagaagtcggtaagaagataaatttgcggtcagcacaaacaaattcagcattccggaagctttttaacctccctccagaagagtttctcattgatgatttcacctgccatctaaaacggaagatgccactgcaggttatccctcctacactgtcaattggcagcccatccttgatggtcatcctgagaaaggatagagggtcagaagcaaaacatggtgccaagggaaccgataacaatggaagattgaagttccattttcagtcctttgtttcgttcggtgatgctcacagaataattatggggatttggaaaatgcggtcaccgggtccagaacagaagggggagataatggaggagtctgaactgaaagaactcccggccgaagaatcagggtccttatttagccatgaagatgtcaaaatgtctgaaatattctcatcagttctctctgtggacaaatatataccagcggcaaatcaaatcaactacaagtttgacaaagcattgtctcgatctggaggagaagcaagcaccactcaacagaagtatgccctagtgaaccaagatgggtgggccattgaagaggtgatgacactccaaggtgttctacttggggactactttagttttgacaaaccattctcaagatatggaggagaagcaaccaccactcagcagacgtatgctctagtgaaccaagacggctgggccattgaagaggtgatgaccctccaaggtgttctacttggggactgcttcactctccagctccagctgaagtatcatatggcgaacgtaccgccaaaaccaaacacctgcagtgtgcaggttttgttggggattgcctggttaaagagcaccaagcaacaaaagaaggtcacaaaaaatatcatgtcgaatacctctaatagattgaaggagctattttctgaagtcgaaaaggatcttacgtcaagaaacggtaccctttttagcgcatctattgatccttaccgttctttacatgatcctaatatcacgtaa

SEQ ID NO: 60 - DNA, 819 bp, Lolium perenne
atggcggccatcaccaccacaaccgcgccctcctccttccgcatctcctcctcaccaccaccaacaacctctaccccccgtagcaacctcaccttccacgcgcgcaaccgctgccactccaggctcgcctgccgtgccaccgatgtgtccggggccgagccctccgcgccgcccgaggccggaggcggccgcacctgggtaccggtcgtgccgctcgcggcgctcccgcgcggggagcgccgggtgatcgtgcaggacggggacgagatcctgcttctctggtacaaagatgaagtcttcgccatcgagaaccgctccccggccgagggcgcatactcggagggcctcctcaacgccaagctcacgcaggacggttgcatcatgtgcccatcaacagatagtacatttgatcttcgcactggggaaataaaagaatggtaccccaaaaaccctgttttaagggctctaacacctgttctgcgaaaactattcgtctaccctgcgaaaaccgatggagaaaatatatacatcagcattaggggagatggtgcctctgttggatcagctgagattttgttcagtgggaaagctcaacctggcagtacagcatctgatgttaacatcgaagaggtgagaatggtagttgatgaaggtgttggaggttttggtttcaccccttacaatgaacttatcaacggaagagctgccataattggctttctattgctgatagattttgaacttttaactggtaaaggccttctcaggggaactggtttgttggacttcatctatgcaatttcaagagctttcagctga

SEQ ID NO: 61 - DNA, 3045 bp, Lolium perenne
atgggtagcctctcgccatggggacagttctccctggtcccatttctactgttacagttcatgcttcacgtgtcctatggctgctccgtggaggagagggctgccctactggagatccggtcttctctgatgagagcgcactccctggaggtgcctgattcatggaggaaggatgatcatgattgctgctcgtggaagcatgtcaaatgcaacaataaaacacagcgagtgtcccatcttgacctttcctccgtatatgcaacaacagagggagatggccattggtttttgaactcgactgtgttttctgtattccatgagcttcagtacctagatctatcatacaattccccttgttccttaagcttgaaaggattagttgggttagccaagcttcgatatctcgacctcagtggcactatgtggggagtgggtttcccagaatttatcggagaaattgtttcactggaagtattagcgctcaacgataacaacatcaccggaggtcttcccggcacagctgttaaaaatcttaggaacttgcgacaattgaatatgacttcgaatagctgcgatggaaacctcccggaatcactattttcacttcctcacctaaagatcctagatctctcagcaaatatctttggtgggcatattccaattagctcagcgtcacaaccaatttcacttgaagtcttggatcttagctctaatcacctcaatggaactctacctgttgctgcctttcaaaacatcaggaacttgaatttgtctggcaaccagttcagaggatctctccatgtatcattatttgcacttcctcatctgaagttcctagatctctcatacaataattttgagggacgttttcctgttagtttgtctccagaaccagttccacttgaagtattaaatctccattataataacatgagtggggctcttccgtctgaacaagcatttgaaaatttcaagaaactacgagggttgtatttgagttccaaccaattcagcggaaacattccagcattcttgttttatcttccacatattgaacggttgaatctctcaacaaatatcttcagcggaccaattccgataaatccatctttgaatcttccattgtcgcttaagagtctgcggttttcccaaaacaatttgagtggtaggatttctttcatttggcttggaaacctgacaaaactagaagtgatagacctttcaggcaatgctaacctagttgttgatgtcaatattcctggatggacacctcagttccagttgaaacagctattactctctggttgtgatcttgacaagagcattattgcagaaccacgttttttacacacacagcatcatctagaggtggttgatttatccaacaataacttgtcaggtagcatgccgaattggctgtttacaaaggaagcaacactacagtatctaaatcttggaaataactcgctaactggattgttggacccaatatggcatacccaatcttttctctatgttatcaacatacacatgaaccatattgcaggacagctgccggctaacatcagctcaatgtttccatgtttgtctgttctggatttttctaataataacctccttgggcacataccatcttcactgtgcgagatcagcttaatgcaacatttagacctatcgaacaacaaactttctggggaagttcctgcttgtgtgttcactaattatcccatgctaatgaccttgaaggtatcaaacaacaagcttggtggtgtgatttttggtgggatgaataatctgtccattatgtcagaattgtgcctggacggtaacaaatttgaagggacaatatctcatgatctgtcaggggttttagaaatcatggatttgcatgataacgagctgtctggcagacttgatacgtcattgtggaatctgtcttctttggtggtcctgaatctttcaggcaaccgtctgaccggcaaaatttatcctcaaatttgtggcttggcaggaattcgacttttagatctatctagcaacaaccttgcaggatctgtgccaaactgtagctttctattgctcaattttcttaacttgtctggaaactccttatctggcgatatctcgtattcctttttcaacacatcaagtctggttgctttggatataagacacaatcagttcacgggcaaccttcactgggtacgctatgttggtaacaccaggctacttttcttgagtggaaacaagtttgaagggcagatcagtccaaacctgtgcaaactcctgtacttgaggataattgatttgtcacataacaagctttcaggttcattaccagcatgtattggtaatatctctttcaaaggcgagacagatgatcagatttttcagccagtccacaggtttatatcgtacttctacagaaatttctatgccccccaaaagtatagtaattcctatgacttcaaaagcttcgcctttgctacaaaagggaatctgtacatatatggtcgcagtttctttctttcgatgtctggcatcgacctgtctgcaaacatgctggatggagaaattccttgggagctaggaaatctaagccgtatcaaatcccttaacctgtcatacaatttctttgttggccctatcccagcaaccttcggtggcatgaaggagatagaaagcttggacctctcccacaatgagttgagcggactgatacctcagcagctaacccagttatcatcattaggggtcttctccgtggcatacaacaacttgtcaggatgcataccgaactctggtcagctcgggtcgttcggcatacagagctacctagcaaacaccaaccttcacaagatcacacatggcaacatgtgcactgctcccggtctagatccagcgccggaggaagatgtgggagagatgtttggtgatccggtgctatacgtggtcaccgctgccacgtttgtgttggcattttgggccaccattggattctcattttgccatccctacggaaggtctgtaatgctcaagctgtag

SEQ ID NO: 62 - DNA, 2022 bp, Lolium perenne
atgaagaagctaggaggtggaggcataccacaagatgcaggtttatcagattttctgaagaacaggctacagaagataccaaggatttctgcccccactcagcttttcttgggtccgcccctgcatagaagtagaaccgtagaaacaccatgtggaggcaaaatcccttcatcagaggagttttccttgattttaccccttcttgctgtctcgcgtctgtcccgtacgaactctctacgaacagagtccgtcgagtcacctgtgcccgacgccttcgccgccctccccaccgccgacgccgacgaagtcggaaccagcagctccaccgccggcggcggcgcaaccgcatcaaatcccatctccccgcgctccagcaaccctctcccctccaccacctccgccacaacccctctcgagctgcccggcgtaccccccgccgcgtccgcacgaaaccctaagatccaccacacccgcggcgtcctccacctctaccgctcctccccctccctgcccgcttcatcctacgcctccgccgtcgccgtcgccgccaccccctcctcttcctcctccgggcccaccgccccaccgctccaatgcgactcgctgctcccgtcatggcgcggcacgcgcctccttgtgctcgccgtccctacccgcgtctcgccggaggacttcgtccgcttttgcggcccctacgttgagcacgcctccgagatccgtgtcatcagcgacgatggggtggaggaccggtacagcgtgcttgtggagtttgaggatcaaaagagtgccgacggattctacctggacctcaatggctggaggttctcgtcctcagaggttgtaatattgccaatttggtgccagttggtagaggtgtgccatgttctgtttatagttgctgtgcaatacatgccatccgctgtgccaccagttggatctactgagcttccgacatgtcctgtttgcattgaaaggttggatcaagacatcagtggaattgtggcaaccaattgtgaccattctttccagtgttcatgcgtttcaatgtgggtcagttcatcttgtccggtttgtcagttttgtcagaagcagtctgaaactcctacaaatcctacatgttctgtttgtcagacctctgaaaacctctggatctgtgtgatatgtggttttgttggatgcggaaggtataaagaaggccactcaattaggcactggaaagacactcagcactgctattctcttgatttggaaactcaacgtgtttgggattatgtcggtgacagttatgttcatcgtcttaatcactcgaaaagcgatgcaaaacattctaagctcaggtcaaagtgtgaattttctggggacaacgatgacttggatatgggtggagttatgtttagcagcaaaactgatacaatcgtggatgaatacaaccgtcttcttgcaagccaacttgaaactcagagagagtattacgaggctcttctgtcagacgctaagaaagatagggaacacatttctgttgctgtggataaagctgtaaatgataagcttcaagagatgcaacttaagcttgaaaatactatgttggagaaaaagaaagttgcagaaatgaatgaaaaactcatgaagagccaggatatatggtccaagacagtaaaaggaatagaggaaagggagagagcgcagttgaggctgaaggatgatacaattcttgacctggaagaacagattaaagacttcaagtactcgattaagttgcaaaaatcgatagagaagagtacacatgctgatgatctcaaaggaggtatgctggtgccactggccatggaatcagaatctggaaagggtgcagagtttgagcattatgtcaacatgtgtaaaaaagatcatgaggcaccataccaaaaaaatttattaccatctaggaaaaactctgactcaatggaaaaattactcatcccaccaaaaaccacaccaccaagcttgttgtttgataccctcaaggtcaagagcatgggataa

SEQ ID NO: 63 - DNA, 615 bp, Lolium perenne
atgtcgaagctgaccgtgggggtgtgcatcatggtggcgctcagcctggccgtcttcctcaccatcgtcgtcctcctcctggccgacctcttctgctcccacctccgcctccgccgcctccgcgctgacgccgagatggcgccgcacaagaggccgaagcttggcgtcccggcgtcgtccccgccgcacaccgccgacgacgcgtcggtggccaccaccaccaccacggcgacgcacgaggcgctctccagcaccccgcccttctactacgcgcacggcgtcatgtgcgcgcccacccgcaaggacctcctcctcgccatccccaagctggaggccgccgtgtggaagtggtctcccgcgcgccgctcctcgccgtcgccttcgccgccgcggtccgagcccaccgcccgcgagtcctcctcctccgcgtacagcgacggcttcctgcgcatctccaaccccgtgtacgagcggggcgccacggccgcgccgggcgggtacgaagaagacacgccgttcgacacgcctgacgcatcgccgtccccgaatgggattacagaggaagagggggcttttggacgtgtcaaccacacgcatcagggagcccgatcatga

SEQ ID NO: 64 - DNA, 579 bp, Lolium perenne
atgaggggatctctcagttaccaggtgtccatctccgggcacagccgcggcggcaaggtggccttcgcgctcgcgctgggccacgccaagacctccctgccactcgcggccctgatcgccgtcgaccccgtggacggcaccggcctcggcaaccagacgcccccgcccatcctcacctacaaagaaaccccgctgcacgtcccggcgcccatcatggtcatcggcacgggcctcggcgaggtgccccgcaacttcctgtgcccgccgtgcgcgccgctgggcgtgagccatgccgcgttctaccgcgagtgcgcggcgccggcgtgccacctcgtggccagggactacgggcacaccgacatgatggacgacgtgacgaccggcgccaagggcctggcgacgcgcgccgtctgcaagagcggcgaggccagggagcccatgaggcggttcgtcggcggggccatggtggcgttcctcaagaaatgggtggagggccggccagagtggttggacggcatcagggagcggccggaggtggcgcccgtggtgctgtccgtcgttgagttccgcgatgaatag

SEQ ID NO: 65 - DNA, 243 bp, Lolium perenne
gagcgaactcagtataggaacccatcctgttctaatagttggaaacgcccgccagtggaagaggttttctgcaaattagtaacacactatgctagagttcactcaaggcaatgcttagatgaagctgaagtagcagagcatgttgttggccttacatccagtcttgcaaattgcaaattcagttactctgtcccgtcattgctatttagacatttaaaccatttctatcacagtagggtataa

SEQ ID NO: 66 - DNA, 306 bp, Lolium perenne
atggcgttcaagaaggtgcagatggcggacaagtaccccaagggccagtcccgtggccgccagtggaagcacctgcgcttcctcctccaggccgccgacgccacctcgcttcccccggaccgccccaactatctaaatattcagtcaccgccatccatttatccaccaaagagatactgtgacgtaacaggttttgaggggtgtattttaggtaccaaggggattcaggatgggaggggatttgttgaattcctcctcttcacccaatcccctctatataaatgtggtttggtaatcagggattaa

SEQ ID NO: 67 - DNA, 5946 bp, Lolium perenne
atggctttggagaaagaaagcatcagaaaggacagttttagcaaagaacaaatccaatatactagagagggaacaggaggtacaccatctacacatttagatttacaagctcatttggagaagattgcacgattggagagatccttgcaaggtttacaagaacaactttcatttgctcaggctgaatgctttgacaaagatgttattttagccaagcaagcaaaagtagctgaagaagccatactaggctgggagaaagcagaagcagaagctatagctaccaagacagaacttgatgacactctacaccagaaagccacagttgagcaaaggatttgtcagcttgatgaggctctaaatgttacaatggtagagagggagttattgataaaggatactgctaaaataatttcttgtgagaaggataaagttcataagctggaagaaaatttagaagagaaacaaaacataattgctagtttggacgatgagtatagcagactatctgaaatcctcttagcaaaagagaaagtcatcttagatctaactgaattaaatgcagtgaaagagtcagacttaaaggaccttgtggtaaagctagagtcaacagagagatcaaattcttctcttagatatgaggtttgtatgctgcagaagcaacttgatattcgaagtgaggaaaggaagtgcaatctcaaatcagctgatgcttcacacaagcaacatctcgaaaatgtaaggaagattacgaagctagaagaagaatgcaagagattgcgttcaatggtacgtaaaaggctaccaggaccagctgccattgcaaaaatgagaagtgaagttgaaacactgggcaacaatatagctcagacaaggatggggaagttaaattctccggcatcatccaattcatatgatccggtacagaatttttctgacgcatcacattcaagttcttctttgcttgcaaggctacatgtgatggaagatcaaaataaatccatgaaggaatcactttctagaaaggatggtgaacttcaattttctcgtactatgcttgctcgtgcaaactctaaactttcccaagttgaagctcaacttgaagaattatcaggcgatcaggctgccacagaactggtaaaaagaagtcctgcactggctgagaaccctctttcatctatctctgaaaatggttgcaatgaagataacgtcagctgttcaggttcatgggcgtcagccttaatttctgaacttgaacatttcaagaaggggaagctgaccacaccttcttgtcagagcacaggagtatcagacatgagtttcatggatgactttgaagaaatagaaaggctagcgatggtatgtgacaataaaccttcaaaattgtatgatgcaaagagagaggcaatagaatcagcaggcaaagagctggttccagttgatggtccgaatgaaacaaacgatcaagttcatcaatacaagattcagaagggactcgttaagttaattgaacttgtcgagggagttattcagagatcgtcaaaggatcacaatagcaaattcgtgcaatctggtgacaacatgggtgatcagtccacagctatagatggttattttgctcatgcgttcttgtggaaaacatcagaacttacttgtgtactgcgacatttcattgttgtatgcaatgagctcatgtatgggaataccgatgccgaaagatttgttcttgaagtgaacctcacactggattggataatcaaccactgcttttcgctccaagatgtaccagacatgagggaaactatcataaatcatttggagttagatagcagcgacgggcttgacgccgttgcagccaagcaaatagcaatccaaaccacaaagggcgtacatgaacccagcaccccaaatagcgtgcagatgtcactaatttctgtttcaagccacgtggatattggacttaaagctgataatgacacgcgcagtataacgaatgaagtgccagtctctaatccccacgaattggaaggaaaatcttcaagtttgcgagcagaacttaatgcattgaaggaaacaggaaaaataaatgcacaaagtgttaactgtgaatcaacagtgagtgaccttgacaaacacaaacccatctgtaactctgaggaaggaaagccatattttgaattcaccattattctacaacccgtaggcattgacaagttaataccttgtcaattggcgccgtttgtgggaactagaggcgtcaaggatccgatctcgatggcacgtttaagatcgtcgacttcatcaaccgcaagcaacgcgatggatcgaggtaaacagatcgcaactggtcttgtcgattttgttcctcacccgccctcccgtttggatgcatatgcgtatctggaggagcctatggagatgacgttcggaagatttcactttcgcgtcgagaaagagggatcgtatcgtgtcgaaattccgatttcgtcgggatcgtcggcggtcgattccgatttttcaagctatacatcgtcaaccgaatcaggagaggaagaaacttcatcgtcacgcttcatcagcaccagggcaagagaaaaacttgccaagatcttcagcgacatgtcgtttgagtcatctgcggactcctatataagcgatggctcaagcagtgtcaacagctacgacttcatcgacaaatctactacagtgggcaaggtcttcgccaatcttcatgatggtgtcaccaaacccaacatagatctgaatacaaagtatcatcatatttatgtcatcggagagccaagtcgtgatcaggaggaaacatctgaggctttcgatgatttgggaaatccatacgtcgatccctctgatttgcgacgaggcctaggcaataaatatatcgggccacagccgcgagacagagtccaacttccgcaagcagcatgggatagagccgcaagggctatggatggctcagaaccaatggccaccacagccacgccagaagaattacaagcatatcaatataggctcgcacgagctgcaagggaattggaaaaacagacagctgaattaaacagaagaaaggaggcagcctctgcatcaaacaagaccttgctggatacttcttgttctggatcatttacacgcaacaaagaagagtttaaaagggaccttcttgatcggatccaagaaaatactgaaggttgggagaacgacaaggatagagaatcaggttttatggatactgataaatttcgtaatatgagtgctacatatggtcttgattctcaagttgctgcaaatctttataaagcttttgcctctcattatgaattgcctaagaagaattttgataagtatcatgaaccgtataaagataaaattgattcatctattaataaatgcgttgtagttgaaactgctgatcatgttattcctgaagcttatattgaaaaaactcctttccctgctaaaatgaaggagtactctgttataaatagtgcggttcataaaagtgaaaagaaacctgtagaacctgaagaacaaataaaagttgaacctgctgttgcaatagttaaagatcttgtgactgaaaatgtggaggatggtcatattattttctgtgaagatgcttctaatattgtttcacatcctaataaacccaaacaagttagtgttcctatgctatctgttagaattggtgatcattgctattatggtttatgtgatattggtgcaagtgttagtgctattccttatgagctttacacggagattatgcacgaaattgattcttgtgaacttgaagatattgatgtggttattcagctggctaatagagaaactatttctccaattggtattgttcgagatgtagaagttctatgtggtaagattaaatatcctgctgactttttggtacttggttctgctgctagtgattattgtcctatcatttttggtagaccttttctaaatacttgtggagctattatagattgcaagaaagagaaaattttgactaaatttgctggtgaatcttatgagtttaacttctctaaatttaccaaaactccttataaagctgatttgcctagtgatgattttaaaatggagcagtgtgcatctattattcttgttcctaataatcctttgcagcaacatttggagaatagcgagagtgaagtttttaggaaagaaagagatgagcttgaggaaatttttcttcgccaacctattctcaagcatgatttaccggtggaagatttgggtacaacaccgccaccaaaggaagatcctgtttttgatttaaagcctttacctgataatcttaaatatgctcatattgatgataagaaaatatatcctgttattattagttctaagctttcagagattgaggaagaaaggttattggaaatattgaagaaacaccgaggagctattggctatactcttgatgatttgaaggggatttctccttctatttgccaacatgctattaatatggaagatgatgcaaagcctgttgttgaacatcagcgtcgtctaattccgaagatgaaggaggtggtaaggaatgaggtattaaaacttcttgaagctggtattatatatcctattgctgatagtagatgggttagtcctgtgcattgcgttcccaagaaaggaggaatgactgttgtgcctaatgataatgatgagctcatccctcaaagagtagttgtaggttgcttgcgaaaccttgataaagttttgcagagatgtgaagaaactaaccttgttcttaattgtgagaaatgccactttatggttaatgaaggaattgtattgggacataaaatttctgagagagctattgaagttgatagagctaaagttgaagcaattgagaagatgccctatccgagggatgttaaaggtattcgtagtgttcttggtcatgctgagttttataggagatttattaaagatttctccaagatttcaaagcctcttactaatcttcttcaaaaaggcgtaccttttgtttttgatgatgattgtaaggaagcttttgaaactctaaaaaaagccttaacaactgctcctatagttgaacctcctgattggaatttgccttttgaaattatgtgtgatgctagtgattttgctgtaggcgctgttcttggacagcgagtagataaaaaactgaatgttattcattatgctagtaaaactcttgatgctgctcaaagaaattatgctacaactgaaaaagaattattagctgtagtctttgcttgtgataaatttagatcttatattgttgattcaaaagttacgattcatactgatcatgctgcaattagataccttatgacaaagaaagatgctaagccgaggcttattagatgggtacttcttttgcaagaatttgatttacatattgtagataggaaaggtgctgataatcctgttgctgataatttgtctagattggaaaatattgcttatgatcctgttcctgttaatgatagttttccaaataaacaattggctgtaataaaggtgagctcgcgagacagtccttggtatgctgattatgctaactttattgtttccaagtacttgcctccaaccttttcagctcagcaaaggaggaaattcttttatgacttgaggcattatttctgggatgacccacacttatataaagaaggagtggatggtattctgcgaagtagtcgtctcagggtaggactgtttatgcatgtcatcatggtgaagtggacggatcgatcggcaatgttgcgagctgatcggcggtcaagagaaaccactagttgcgagtacatgttgtattcagtcaagtcctacactagtttgagtccaccgtcagtgcatgtagctaaggatctatacgttgggcgagccgagagactagcgctatatgagctgagttag

SEQ ID NO: 68 - DNA, 1536 bp, Lolium perenne
atggacatggatagaataagatacactaataatattgatgatggtggggagatcaaagcaccaataccatatgacgagcagccagagtcgttcccttctttgaatgcttccttgggtaattttccactaatgccagaggacattgatcaaagatcaggcagttctctggatggccgtcgtttagcgtgcaagaggaaaaccattgagggagcccatgggatattttcagcaggtgctagcactagtttttcccacagaaatgataatgtcttccataacattccttcaacaagtttcagtcctgctcctaccatgaatgtgccctctcataattttttgttacctccaagttctatcgaggaacaactcccccactatggagcaactacaggactgccatctagtagctacaatcatcctagtggaggcaattataattctggaaactcacaaagaagtttccgggtaagaactaccaccgctcagcaggttaacccatacggtgtatggccttcttcaagtaccatgagtcattccagttcatggaaccaccaggcgcctgcccttcagagcgcgtttgatgaaatgcaagagggtattcccatggtcagtggaatcaacttgcaataccaacatcctgcaaatgtagttcctggcattccacaaatagcacaccgttttgcttgccatggagcttcatcatctagagcgggcagtttggataacagaattcttggtagtgaggacgttactgggaggagtgttgcagctcccaacttctctaatgcagcgcctcttgctggaatagacatgagacctttggttccagaaccatctacctggaattctgatctccgtggcactgccatccctggaaatgtttcttctgtatctagagctaatcctagttcaatagttaatcgaccagcaggctcaccatctgtcgctcatccaaccctgcatagacgacatcctagaaatttatcagaggagataggtcgtctatctggagcccttcgtggtcagcagcaaccacgtttaaggtcggggtttctattggaacgtcagggtgatggtgtttggggtgttccattaccaatgaggagtagtagggaaggaagaaggttaatagagatacggaatgcactagaaatgattcaaagaggggaaaatgtcagatttgagtctattttctatggcggtgtcgacattcatgatagacacagggatatgcgtcttgacatagacaatatgtcttatgaggagctattagcactggaggaaagaataggaaatgttagcactggcatcagcgaggacgatgtgatgaagctcctgaagcaaagaaagttctcgtcctggagattagcatcaatggaatatgagccatgttgtatttgtcaggaagagtacgtcgacggagacgatctcgggacgctccactgtggtcacgacttccatgcgggctgcatcaggcagtggctggtggtgaagaacctgtgcccgatttgcaagaacaccgccttgaagacctaa

SEQ ID NO: 69 - DNA, 630 bp, Lolium perenne
atggcgcctcttgccgccgcggccgcggcggtggcggcgaaggaggagctgggcgtgacggtggccgtggcgccgccgatggcgctggccccgctgagccagcagcagccgcggcggcagtaccgcggcgtgcgcatgcggaagtggggcaagtgggtggcggagatccgggagccgcacaagcgcacgcgcatctggctcggctcctacgccacgcccgtcgccgccgcgcgcgcctacgacacggccgtcttctacctgcgcggccggtcggccaggctcaacttccccgacgagatctccgcgctggcgccgctgtccccgccgcccgaggagctggaggccgacggcggcgcgctgtcggcggcgtcgatccggaagaaggccatcgaggtcgggtcccgcgtcgacgcgctccagaccgggatgaccatggtcgccaccgccgccgcgccggcgacaaaccaccgggagcggcagaggcagcaccacgcgcagcagcaggctgcgcgcgacgaggagctgctccagctccaccaccagaagcagcagcggacggcgtggaacgggcgggccaagaacccggatctcaaccaggcgcccgaccccgacagctccgacgccgagtga

SEQ ID NO: 70 - DNA, 1950 bp, Lolium perenne
atgaggaaatctaactggtgttggcctcgcagattttgtatgttcgttgccaagaaaaaacactgtcaggcactcaaactggaaaatccagctggcaatgatagccctgttggtcctatgcagggagaacatacagaaaccttcgtggccattttcgctgcgaagaaagaacactatgtgtgttcaatcgtcgtccactttgtcgtcaccgtggtagtgcctgcggcaggatgtgtcgtcaaacaccttcacgctcatcacctcgacgccttggtaggagaatgtgagtacgcggctagccgacttggaggtcgtggaaccgggagaacttctcccggccgatgtggagtggagccagaagaggtgggggaacgaccgagacaccagacacggcaagaaccggaggaaggcggcagctcgccagccatgtgggatctcaatgactcgccggccgccgacgcgccgcacgcgccgccgctctccccgtccgtcgacgactccggcgcctcctcctcctccgccgccgcggtcgtcgagatacacgacgacggtgacgacgcctccgccgccgcagccgcggaagagcccatgttcacccgccagttcttccccccggccgtccccggcgaccccgccccgggcaacggccgcgcggcctggctccgcctcgccggcgctccccctcccgccgcggccgccgcttctgcggcagcacccggtgccggcgcaggacccgccgccgcagcggcatcagcagcaaacaagaagagccggcgcgggccgaggtcccgcagctcgcagtaccgcggcgtcaccttctaccgccggacgggccgctgggagtcgcacatatgggattgtggcaagcaggtctatttgggaggatttgacactgctcatgcggcggccagggcgtacgatcgggcggcgatcaagttccgcggcatggaggccgacatcaatttcagcctcgaggactacgaggacatcaagcagatgggcaatctgaccaaggaggagttcgtccacgtgctccggcgccagagcaccggcttcccgcgcggcagctccaagtacaggggagtcaccctccacaagtgcggcagatgggaggccaggatgggccagttcctcggcaagaagtacgtctacttgggcctgttcgataccgaggaggaagccgccaggtcctacgaccgcgctgccatcaagtgcaacggcaaggacgccgtcacaaacttcgatcccagcacttacgccgaggagttcgagctgcccgcggctgcttcgacgggcgacgacggcgagcagaacctggacctgtcgctgggcagctcggcgggctccaacaaacggggcagcctcgacggcggcgacgacgacggcacggcggggtccgaccagcgcgtccccatggcgttcgagctcgactggcagacggcggcgcggagcaccaaggccaagttcgaccaaaactcgacgcatcaccagatgccccctcccgtcctgcaggcctcccacctgccgttcagccccaggcattcccaagtgggtactttcgccatgccattttcgagggaattttctcgaattagcagcctgttcttgttcgcgagcaacggcgatccggggacagcgggaggcctgtcgctgacggtcggtggcgccagcggcggaggcggcgggcactggctgcctcatcagtaccaccaccagcaaccgccgcagcagcagcaacagaggctgcaccacggtggctggggcaacggcgcgcccggcacgagctggccgccgccgccgcaaccgcacctgccgacggcgccaccgtccaacgctgccgtcgccgccgcggcagctgcagcatcatcacgattcccaccctacgtcgctacgcaagcccacagctggctgcagaagaacgggttccactccctcgccagacccacctag

SEQ ID NO: 71 - protein, 270 aa, Lolium perenne
MLLLIRRLTAVPSRLAALALRQPHGRAATTTSTTPAVSSSHLAGSPPAEDPAADPGCESEPLDRDWGSTLSRADPAEVAGILRRLHDETIHLGLGTYNLLLERACEAEDFALFAKVFRYLLLSKAAPDLTSYMHVARAIGDLDDPEPMLRFVREVLEVTQGRDPTVVNRIVFATGKYGHIDKSLIIFEELKKDKKCLDVVTFNTVLDMLGKAGQIDRMLREVKLMEELGISPDIVTYNTVINCLRRLGRLDMCKSFATEMVERGIGPDLR

SEQ ID NO: 72 - protein, 385 aa, Lolium perenne
MAPPAATVAVLGDDLLREVFILLPTPTDLLRAALACKPFLRAARSAPFLRRFRRRHPFTCPLLLGCLLHGPTDRRRTTASHLLPAYPDAATRRLIDGADFTFSFLPRRGWPQAAGSAWQLLDCRNGRALLLSRASRALAVADPLTRRSVTLPAIRGLGYALVADDGDSSLFKAVCISRRVGAPGLRAFLLSSADLRWVQVAVAGLDDVQPDLAGSRAMQANGSLYWKLVGGEHMVALNTETMEFAVLELPPFLREISFDIIEKGEDAAAGLYLLTMRGFCIEVWAGVKDGADGGLTWTLVEKSVMFHRAMAEMLGSEFLYQNRLDVIGVVAGVVFLRNGECLFSIDLQTMKMTRVSPKENCPSHLIYPCTIAWPPSFLNPTEQGA

SEQ ID NO: 73 - protein, 104 aa, Lolium perenne
MSAAAGGLRQLLTAAVTAGAAEARAAVFGHAVNPSGKRAATKLLRRKFIGEQLAQWYPYDIKRDDPIVMAREEKERLTKLEMLKRRGKGPPKKGQGRRAVKRTK

SEQ ID NO: 74 - protein, 79 aa, Lolium perenne
MAVSADLSKEEALKLAAGMALSSTAAVRASAGKAGDAANNSYARSGSISARTSSCATTTSFGSARTNTVSATLALAVSA

SEQ ID NO: 75 - protein, 292 aa, Lolium perenne
MEMKNGDYASVSLELVTAHAQARATFEVRLLDQAGKLPPSVVLARYKPLLFRSNPPTYMSEDFLQPLPYLHADDSLVVECDITVIKESELALVHSTFDIKVPPSDLSQNLRQLLEAGDESDVAFEVRGEVFPAHKLVLAMRSRVFKADLFGPMGDRTRKTIPIEDMQPAVFGALLHFIYTDSLPSMEHLHGDDAEEMVKHLLVAADRYAMERMKVMCESILCKTLNVRNVTTTLALADQHQCSHLKDACLDFIASPDRTDDVVASEGYACLKRSCPAVIADIFERATKSRKI

SEQ ID NO: 76 - protein, 91 aa, Lolium perenne
MAAVAQRKTKGSSAASTGGAKTKRRRKTKVLPPLLSPGTAVEVLRNGKWVGGGTVTIRNDRTYMVSLPEGMTVLMTRGRVRPTAGYGTLYS

SEQ ID NO: 77 - protein, 333 aa, Lolium perenne
MRIASRRVNSASCDEITALRSEAKVASELVTSVSRRVKGAGSEQRSLHATSNRMMLSQEEMFNYSTKKQQATHIFSNLRKQISSILIADIEELRAKGCIISLACSDHTSSEANVAINISHSLSFKECPLALSPVSSELCLGIHSDIAEQKLEHWSSVAPLALEVVLSIGQKARDGTLSDNDVNDTAGDGNIESMLLVEKGLRELASLKINVAIFMITKLPSAGPVYPAENHSSSEPLELSEEEREDVRFKQAWLTYFWRRAKNHDVEEDIADERLQFWIEQGNHPVTTSDVIEVDRGLHELKKLGVESQLWEATRRSLDDDFSNHGSPFGSEV

SEQ ID NO: 78 - protein, 170 aa, Lolium perenne
MEQCDAEIPSSGRGLSYGGDSCREDRLSALPDDLLIHILLKILDAAGAARTSVLSRRWRRLWTLLPELLFPNSNPHHIRLALTAHEAPALRKLAVTVTDPNPESVAAWLPIAARRLSGDLFLFNMAQRNESEDEAGERGAFELPCFERATAIVLPCQGAPCPLTVSIAAC

SEQ ID NO: 79 - protein, 162 aa, Lolium perenne
MEQCDAEIPSRERGLSYGGDGYREDRLSALPDDLLIHILLKILDAAGAARTSVLSRRWRRLWTLLPELLFPNSNPHHIRLALTAHGAPALRKLAVTVTDPNPESVAAWLPIAARRLSGDLFLFNMAQRNESEDEAGERGAFELPCFERATAIVLPCQGPLAP

SEQ ID NO: 80 - protein, 412 aa, Lolium perenne
MGADLGAELGALALKYTGVSLSVSDYDSIVAMNIFVALLCGCIVFGHLLEGNRWVNESTTALVMVFAVLSRWGRVAWLITGGVILLVTNGVNSRILVFSEDIFFIYLLPPIIFNAGFQVKKKQFFRNFATITLFGAIGTLISFVIISLGAMGLFSKLDVDPLQLGDYLAIGAIFSATDSVCTLQVLNQDETPLLYSLVFGEGVVNDATSVVLFNAIQNIDLDHFDAFVLLQLIGKFLYLLFTSTVLGIALLDLSGILTVFFCGIVMSHYTWHNVTESSRVTTKHTFATLSFIAELFLFLYVGMDALDIEKWRLARSRELIIWWAGLMRGAVSIALAYNKVFGLLTKPLINLLIPPRPSNTADGSSQSFLDPLLSSLLGSDLDIGQYPPQTNLQLLLTIQTRSVHRVWRKFDD

SEQ ID NO: 81 - protein, 417 aa, Lolium perenne
MASQISGTVASSGVGYNDQYGMPCKMKGLHCVSLNCIPPNLEARKGMSGYHLVVRFCSNDRYGQTTLKSNSSMLRQGQSVWCRSYGPRGSSETKERESSEDDNDAYRDFKEQPRGNSQFSDDQVAAQKKSLYSIQGLSKACQFVYNDAKFVNERAQSDILLLSRGITRLNKRASQDVAVLGLGFLKLDARARKDTQKIDNSVKERAAHLTNFARILKERAESDLKKAADQHWSDGALEADLRRADMVVRRRAMEDAFMALKFVRDIHDMMANKLQDQIPKDASFSQDAYLSMASALSEADGIDYTDPEELELLVAALIDLDAMDGKRSVSLLAECSSSPDVNTRKALANALAGSSIYVDSRECWDGCITASSAARAIDELRKQWELEEGDSLRFVVNQNLDTKETGDDSSAEDDTTP

SEQ ID NO: 82 - protein, 561 aa, Lolium perenne
MGQPTDRVDDFSSRGKVARVWCMRERNSTFRKILGIYVEGLIFPEESRSQKGRPGGGPGPPNNRLARPVGWRAALACGPLGQPLTPPSGLLKGFDLKTRDGKSKSRETIQYAATVAKLRLGTRNSVLAPRRDGELEEIIAIITTDASPSTSHVSPIHIGAVARIRHQLAYATHTFFDKEDFLYIHTPIITTSDCEGAGEMFQVTSLFSQAEKVDKELKENPAPSEADVEAAKLVVKGKGDAVAQLKAAKASKQEITAAVSELTKAKEVVLRLEERSKLKPGIPHKDDGSIAFENDFFKRAAFLTVSGQLQVETYACALSSVYTFGPTFRAENSHTSRHLAEFWMVEPEIAYANLHDDMNYAERYVKYLCKWLLDHCREDMEFMVKHVDKTAIERLELVSSTPFERISYTKAVEILEGTGKKFENKVEWGIDLASEHERYLTEVIFKKPVIVYNYPKGIKAFYMRLNDDQKTVAAMDVLVPKVGELIGGSQREERLDVLTQRILDADLPLEPYEWYLDLRRFGSVKHSGFGLGFERMILFATGLDNIRDVIPFPRYPGRADL

SEQ ID NO: 83 - protein, 225 aa, Lolium perenne
MAPAAVKVYGWAMSPFVARALLCLEEAGVEYELVPMSRQAGDHLQPDFLARNPFAQVPVLEDGDLTLFESRAIARHVLRKHKPELLVGDGSPEAAAMVDVWLEVEAHQHHAPTAAIMVQCILAPLLGGARDQAVIDENVPKLKKVLEVYEARLSKSRYLAGESVSLADLSHFPMLRYFMETEYKALVEELPHVKAWWEELKARPAARKVTEFMPVDFGLGKKAEQ

SEQ ID NO: 84 - protein, 228 aa, Lolium perenne
MAQTAVKVYGWAVSPFVARALLCLEEAGVDYELVPMSREAGDHLRPDFLARNPFAQVPVLQDGDLTLFESRAIARHVLRKHKPELLVGDGSPEAAALVDVWLEVEAHQHHPPTGAIMVQCILTPLLGGVRDQAVVDENVAKLKKVLAVYEARLSASRYLAGESLTLADLSHFPMMRYFMETEYAALVEELPHVKAWWEELNARPAARKVTEHAVNAAKLWALEKAEQQ

SEQ ID NO: 85 - protein, 159 aa, Lolium perenne
SRETRIGNTGRSIDRSARGPARRDGVSGAGGDADLGQGPEEGDGVLQDAGVRGGVHLRRRPAHADAPDALGPARRAAAVPNTDRRRPPRARTARAPPLRALLRRPRRRRGARPRPGPFRRSASRRRASPPQLPGATPHERPEARGAPHLLQPHGRAGDR

SEQ ID NO: 86 - protein, 814 aa, Lolium perenne
MVLSIDTGEVTAECERMEVVRVRGEAWGLGIGEDVKMVWSRMRRVKCRGGARPLKGRQRVPEKENAPAAKGRRGAAGAAARLMEKIVPGAPAIKLKASKKDQYLLKRRDDARAPALPPVVLPDATPAPDDGGPPPGFPSAEPQTPPLPSSAGGGDDEEFMLQRRTLPSAGQASDGGATADDATAAAPKKAAKPKKARKREREVAAEATADESAAAGEPKTKKKKKKLAELNSGAPSADPSGGGAKPAAFSPPKVDLDGLDLKQVISDLENLPLLPSYGAGRSISDGSHSFLLAFRSKHYKKSYENDPSEESKKSLDTKPNAAVAAAVDGQPPKPVKKKPVMRPIDPTIAGVKRGPSDRQEEMATKKKIKLEKIKTLAAEKKAGLEPKVVTAPASAVGGVTPAAQQPRAGMKEKALGLVKKKVPAAAPARRMASPTALMMKFPPNSTLPSVASLKARFARFGPLDIDGIRVYWKSYMCRVIYKYKSDAEMALKSAKSTAMFGQVVPNYHLRGIESSSAGADMGPEPAPPAQQRSELRLMETTPFRPGSSGNGAPLTLSRAAPARAVVGQPKSILKKNNDDGGASALRDSPRVKFMLDGGDSKLEPPAIPASGNSPDAAAPVSKVARSVGFAQPPLQPLARPAQPNMQPAMRAQQQQLQPPRALDTQALPPPPPLPYQPRASEPLPYQPRVSEASPYQPRHTDAPPSFNNMQLPYQARHIDVPLMLSGQPTLPYPPRASFARSDDMPPPSHFDNNAANAMPAPFDRNAVNAMPVWKRGEKEFSEELMRVMLGIAKLVEPLMDKNGNFPYHLFGRSA

SEQ ID NO: 87 - protein, 311 aa, Lolium perenne
MVVPVIDFSKLDGAERAETMAQIADGCENWGFFQLVNHGIPLELLDRVKKVCSESYRLREAAFRQSEPVQTLEALLEAERRGEAVAPVDDMDWEDIFYLHDDNQWPSDPPAFKETMREYRAELKKLAERVMEAMDENLGLDKGRMKAAFTCDGIHAPTFGTKVSHYPPCPRPDLVTGLRAHTDAGGVILLFQDDKVGGLEVLKDGEWLDVQPLADAIVVNTGDQVEVLSNGRYRSAWHRVLPMRNGNRRSIASFYNPAFEAAISPAVAEGGAAASYPEFVFGDYMDVYSKHKFEAKEPRFEAVKAPNTPQA

SEQ ID NO: 88 - protein, 311 aa, Lolium perenne
MVVPVIDFSKLDGAERAETMAQIADGCENWGFFQLVNHGIPLELLDRVKKVCSESYRLREAAFRSSEPVRTLEALVEAERRGEAVAPVDDMDWEDIFYLHDDNTWPSDPPAFKETMREYRAELKKLAERVMEAMDENLGLDKGRMKAAFTCDGIRAPTFGTKVSHYPPCPRPDLVTGLRAHTDAGGVILLFQDDKVGGLEVLKDGEWLDVQPLADAIVVNTGDQVEVLSNGRYRSAWHRVLPMRNGNRRSIASFYNPAFEAAISPAVAEGAAAASYPKFVFGDYMDVYSKHKFEAKEPRFEAVKAPKTPQA

SEQ ID NO: 89 - protein, 228 aa, Lolium perenne
MRVTITGGGTRLHVDLYYACVQSRALFTVWSLLQLMRRHRGRVPDVDLMFDCMDRPAINRTEHSGEGAPPPPPLFRYCTTRDHFDIPFPDWSFWGWPETHLEPWSREFKSIRQGAKKNWDEEARSGYQNSKLSSQCTHRYKIYAEGFAWSVSLKYILSCGSTALLIDPLYQDFFSRGLEPRVNHLPVSTVGMCESIRDAVEWGNAHPDEAERVGRRGQRLMQDLAMDA

SEQ ID NO: 90 - protein, 746 aa, Lolium perenne
MAGQGQDRKTIDLEEGWAYMEGGIGKLVNILEGKNEPQFNSENYMMLYTTIYNMCTQKPPNDYSQQLYDKYREAFEKYIRDAVLPAIKEQHDEYMLKQLNVRWKNHKVMVRWLSRFFHYLDRYFITRRSLTPLNDVGFICFRDLIFQEIKGKVKDAVLVLINQEREGEQIDKTLLKDVLDIFVEIGLTTMEFYENDFEDFLLKDTTEYYSVKAQNWIVEDSCPDYMIKAEECLRREKERVSHYLHINSEPKLLERVQNELLANYATQLLEKEHSGCYALLRDDKVDDLKRMFSLFSKITRGLEPVSNMFKSHVTNEGTALVKQAEDSASNKKPEKKEMVGMQEQVFVWKIIALHDKYVAYVTDCFHGHTLFHKALKEAFEVFCNKGVSGSSSAELLATFCDNILKKGCSEKLSDEAIEDALEKVVRLLAYISDKDLFAEFYRKKLARRLLFDKSANDEHERSILTKLKQQCGGQFTSKMEGMVTDLTLARDHQTKFEEFVAEHQELHPGVDLAVTVLTTGFWPTYKTFEISLPSEMVKCVEVFKEFYQTRTKHRKLTWIYSLGTCNINAKFETKTIELIVTTYQAALLLLFNGVDRLSYSEIVTQLNLSDDDVVRLLHSLSCAKYKILTKEPAGRSISPNDVFEFNSKFTDRMRRIKIPLPPVDEKKKVVEDVDKDRRYAIDASIVRIMKSRKVMAHTQLVAECVEQLSRMFKPDFKAIKKRIEDLITRDYLERDKDNANTYRYLA

SEQ ID NO: 91 - protein, 449 aa, Lolium perenne
MAPPLPGPRPPAGGSRRPRPCPGSATSAASLVRAPASDPRPSWMLKSETKPEDGSISNRVQRLAKYRFLKKQSELLLNADDLDAMWVCLRENCVIDDVTGSEKMNYEDFCHIATVCTEQIGQKCKRFFSPSNFMKFEKDDSGRIAILPFYLYVMRTVSLTQARIDMSELDEDSDGFLQPHEMEAYIRGLIPNLAQLRDMPSAFVQMYCRIAARKFFFFCDPHRRGKACIKKVLLSNCLQELMELHQESEEEVTDTEQAENWFSLTSAQRICDMFLALDKDTNGTLSKQELKEYADGTLTEIFIERVFDEHVRRSKVGGGNSREMDFESFLDFVLALENKDTPEGLTYLFRCLDLNGRGFLTTADIHTLFRDVHQKWIEGGNYELCIEDVRDEIWDMVKPADPLRIALTDLLSCKQGGTIASMLIDVRGFWAHDNRENLLQEEEEQVEEA

SEQ ID NO: 92 - protein, 574 aa, Lolium perenne
  misc_feature (12)..(14): Xaa can be any naturally occurring amino acid
  misc_feature (66)..(67): Xaa can be any naturally occurring amino acid
  misc_feature (127)..(136): Xaa can be any naturally occurring amino acid
  misc_feature (182)..(199): Xaa can be any naturally occurring amino acid
  misc_feature (296)..(296): Xaa can be any naturally occurring amino acid
  misc_feature (371)..(371): Xaa can be any naturally occurring amino acid
  misc_feature (494)..(513): Xaa can be any naturally occurring amino acid
MFRSMTNRVCRXXXGHLLSPVFIEYTRSPPILASFHRVHCTTILRPTHYIGTRQCAAQSTLQTSIXXPSPACCLPSGLSHFSFGIHCTFGVQICDVVLNPWSLKQLGIILVTIVVGFVLVLVFGCIXXXXXXXXXXALQSFLSGFIVWVYPCSLIVGECIREKICRRKYLSQLDMRIICPLXXXXXXXXXXXXXXXXXXQPVPMLLQEIQVRDEWQIHRTFLPSLFHWNLHAHHQLTGLSQTDAPSLLHVQIMHLYIKVLDKHVPNLDKSEDQPLAPELPSLLLPDLADSMKDANXPFIIPVICLSSTRRLFSAYIKAFLSSFLSQNAARAIHVSGLAGSICSISCTNLFSLVSDLNFRRIAYSSIYVIMXWINPSLLKIHDCFIILANDGFNLCNFQQDVHIIGESLQFHVYIKATFIIMSNATLRLYIPIPPTLCIYKITWWLASSIWCLKKRKLLRRKPHFSQSCNSLKYIRALPQTLFITYGRSTVISGXXXXXXXXXXXXXXXXXXXXSLKGVAFEEFGEGERPVVETEILVELVACLGILLLHCTACLAPRALRNSFSPYNASPCRTK

SEQ ID NO: 93 - protein, 273 aa, Lolium perenne
  misc_feature (101)..(101): Xaa can be any naturally occurring amino acid
  misc_feature (156)..(156): Xaa can be any naturally occurring amino acid
  misc_feature (216)..(217): Xaa can be any naturally occurring amino acid
PRLSPPRKMLETFPPFLAVRNCPKHDKQVANETHPVPTKPICILAFELWRSVHSFDPAQHNRILCISPDVLRNSSKHLVVASVLLVAAPRGYVAFHWEPAXRCFGENYVQELIDKAPQLPEDIEWHFIGNLQSNKAKALLAGVPNLDMVESVDDEXNLRHKLSWTDLLHSANVLCLLIAALASCRKEVCDELGIPEEQCELSMGMSADFEQAIEMXXAQISELDQLYLVQENTRRRTRITIYSGFVAAVPANMYYSRLQIKYWICIQFLQHSA

SEQ ID NO: 94 - protein, 1064 aa, Lolium perenne
MGKPAEYEDDDEEVSTSVGDEQPDEEEQESDGSEEEEDEPEGEQAAGDAEDEEEEVDEEEIVAATTGAGADDDDDAGDGAGEAESTEDDEAVAPEEGGEEDADESEDAAGNAEVGKRERAKLRQMQKLKKQKIQEILDSQNATIDADMNKKGKGRLKYLLQQTEIFAHFAKGSQSAEKKSRGSVCLLCFANVVRTYRGRHESKVTEEEEDEEYLKEEDALASAGGTRLLIQPSCINGKMRDYQLAGLNWLIRLYENGINGILADEMNHIRENLLAPGKFDVCVTSFEMAIKEKTALRRFSWRYIIIDEAHRIKNENSLLSKTMRLFSTNYRLLITGTPLQNNLHELWSLLNFLLPEIFSSAETFDEWFQISGENDQHEVVQQLHKVLRPFLLRRLKSDVEKGLPPKKETILKVGMSEMQKQYYRALLQKDLEVINAGGERKRLLNIAMQLRKCCNHPYLFQGAEPGPPYTTGDHLIENAGKMVLLDKLLPKLKARDSRVLIFSQMTRLLDILEDYLMYRGYQYCRIDGNTGGDDRDASIEAFNKPGSEKFIFLLSTRAGGLGINLATADIVVLYDSDWNPQVDLQAQDRAHRIGQKKEVQVFRFCTEYTIEEKVIERAYKKLALDALVIQQGRLAEQKAVNKDELLQMVRFGAEMVFSSKDSTITDEDIDRIIARGEEATAQLDAKMKKFTEDAIKFKMDDTAELYDFDDDKEEDKPDFKKLVSDNWIEPPRRERKRNYSESEYFKQALRQGAPAKPREPRIPRMPNLHDFQFFNTQRLNELYEKEVKYLVQTNQKKDTIGDGDGDDEDQLEPLTEEEQEEKEQLLEEGFSTWTRRDFNTFIRACEKYGRDDIKSIFSEMEGKTEEEVQRYAEVFKERYTELNDYDRIIKNIEKGESKISRKDEIMKAIAKKMDRYKNPWLELKIQYGQNKGKLYNEECDRFLLCMVHKLGYGNWEELKSAFRMSPLFRFDWFVKSRTTQELSRRCDTLIRLVEKENQECDERDRQARKDKKNMTSSKRPAASSPAFESPIQSSSKRGRRDGSAASCSWVNQIIELVKAFGDLS

SEQ ID NO: 95 - protein, 615 aa, Lolium perenne
MGFGRSRWTGSTALVINWRPLLYCRKEDINGHSGLRRDLPVASLLLRVDASMYKNQLQELAQRSCFNLPSYACIREGPDHAPRFKATVHFNGEAFESPTFCSTLRLAEHAAAEVALNELSKRGPSSSLAAKVLDETGIYKNLLQETAHRAGLKLPMYTTIRSGPGHTPMFTCTVELAGRIFTGNPGKTKKQAQKNAAMAAWSELKELPRVGEVASSSSPSDHDNEEQEQVTVVRTLESLNQKNEGKAPHQKEKQQRNNRPQPRRSYPKPSASFYGSRLQNQTYPNVAQEQAMYHMWHQVQPTQQKPHFRMVPTMGNTRFPPPPTILSMYPPPRGQFAVPASQDALALIPCFPEAAPALPRYFSPYPASYVPASPLPAAVNMMHGRRQGCAETVELPDAPVFARYTAPDYSSALENVCPSEVQQWPKNGKEAYTESSAATEEKNKAPQTSSSSTTHHPSQKLEPNEDRESKKPAEQPLLGPYVVQRPVQRQSYPSPVQHSEPIHRNNLPFRTATSPGPWSSDMQTPPRFGTATLANSASFLYQQRPPWLAAPVTVRTSIPVCSARPNAAVNSSPGAATRVRSTVQMLSRNNSEAQRNTRDMSDASTASSELSKLHI

SEQ ID NO: 96 - protein, 401 aa, Lolium perenne
GNIDICSNARNVFAYNGPVNFTVLERLVSRCRNLKTLKLNNAIPLDNVASLLRKAPQIIELGTGKFSADYHPDLFAKVEAAFAGCTSLRRLSGTWDAVPDYLPAFYCVCEGLTSLNLSYATVQGPELIKFISRCKNLLQLWVMDLIEDHGLSVVASSCSKLQELRVFPSDPFGHNGGQVFLTERGLVDVSASCPKLESVLYFCSRMTNEALVMIAKNRPNFTCFRLALLEPRSPDYMTRQPLDAGFSAIVESCKGLRRLSMSGLLTDLVFKSIGAHADRLEMLSLAFAGDSDLGLNDILSGCKSLKKLEIRDCPFGDKALLANAAKLETMRSLWMNSCSLTVGGCRLLALKMPHLTVEIINDPGETCPVESLPFDSPVEKLYVYRTLAGPRSDTPDCVQIV

SEQ ID NO: 97 - protein, 373 aa, Lolium perenne
  misc_feature (56)..(59): Xaa can be any naturally occurring amino acid
  misc_feature (196)..(202): Xaa can be any naturally occurring amino acid
  misc_feature (325)..(327): Xaa can be any naturally occurring amino acid
MEASSVGADVSADHVIAELLEMGFEFDKISEAIGVVGPCRADVVEFMLNGSGGEQXXXXGGSQRRCPDRSTRLANPRGKFKQSSITDHIASTTGSKTVSRGGEPSTSYSCLSASIDPSLTAAICSKSKPEPQSSLVNSRGEFDRTGKISAVLQKHFGFSCVKGFQKEALDAWFARKDCLVLAATGSGKSLCFQIPXXXXXXXALLTTKIVVVISPLISLMHDQCLKLAKHGISACFLGSGQPDNRVEGKAMAGMYKIVYVCPETILRLMEPLKKLAEKPGIALFAIDEVHCVSKWGHDFRPDYRRLSVLRENFCSSKLKFLEHDXXXSFDGIDCYCNFPCTRRHSQVLENVRTYSGCLDVLFPAKPSIYCKAQ

SEQ ID NO: 98 - protein, 238 aa, Lolium perenne
MAFSRLLPSRRLLSTLLHTPTPTPAAPATDATTTTPFAHNLHPARFFSATRRAGPGAPREPRAADIGARARQLQSRRLWTYALTFGCAAGFVVTMLATSQDQLVFYLTPTDALARFATDPSKTRCRLGGLVLEGSIAHPSSSASEIEFVEGALPDLFREGHSVVVEGFLKPLSDDLRLDGAGRKVSDKAREGQYFLQGTEALLPSLAPHFFCYHVSGEVSGEFFCEVSDEVFSIKGLY

SEQ ID NO: 99 - protein, 245 aa, Lolium perenne
MAGAGSSPLGGQLSRQRGWQQRQEEEEKENKNKPAAPVPAQGNATVEGSGGGGSIPLENQDNGGTCDEASGDEQPQKPEGGSGGGPHVVAPFAMTPHGIQPMAPTANANAAGGGVKKKKKGKGGGNGSANANADGAGATAEMIPHDATAGNAGQHAAAAVDAGAYPPATTMSYPGYYAGGGQMPPPYAMSYSTAHPLRSSAYYHPMVGAAYTGGAEYFHSTAPISAAPRSYYMFSEENANACSVM

SEQ ID NO: 100 - protein, 633 aa, Lolium perenne
MALSMVLAHYSEGFDVEEVTAGFPSETGEFDVAEVLRLMDAVRPFADRVLATADLETHIPSQAAPGDAEKEPGPVDYPAERLFHAAAAGSLSTYPVVVSRLATPMKAIDLTVFLFELGVPSRTFSAASFSDSATARRKAASSSAASASFSPARGSPPLPPPLTAYTPAGQLQSQHLNSLLSDRDYTWNDNGELIRISSPRQTRSYSYSTTGRLTGVHTTAANLDIRIPYTTDPAGNRLPDPELHPDSALSMWPDNRIARDAHYLYRYDRHGRLTEKTDLIPEGVIRTDDERTHRYHYYSQHRLVHYTRTQYEEPLVESRYLYDPLGRRVAKRVWRRERDLTGWMSLSRKPQVTWYGWDGDRLTTIQNDRSRIQTIYQPGSFTPLIRVETATGELAKTQRRSLADALQQSGGEDGGSVVFPPVLVQMLDRLESEILADRLPLPKHINEENILNEISIEKDVDGFHPLNIGKLAMKGRDPLFLPCTPKGCMELLSRSGVTVKGKNAVVVGRSNIVGLPVSLLLLKADATVSIVHSRTPNPEVIVRQADIIIAAAGQAMMIKGDWIKPGAAVIDVGTNSIDDPTRKSGYRLVGDVDFTEASKVAGHLTPVPGGVGPMTVAMLLKNTVDGAKRGIVS

SEQ ID NO: 101 - protein, 1191 aa, Lolium perenne
MATPLASAPPPFIPVQLDPSKDSDKNVEGTSAHPEKTSGADQAEQKAEEVAAKKSKARQRDSEAKGKWWPCTTTETELNNLEAEGFLRPGSWRTVSGSLVPAPEAGEMVVTKALVERDFSFPPCDFFSEILKAYGLQPHNISPNSVLAISNHVTLCEGHLRDVSDPASERVLPPFKNSPTSENPAWMQCPHLFESPQLTRAVRRICKLTEEGLSGKDLTMSWFTKWIQPLQHRDSLMFQYTGRDDPMRASKDNLSADAIDKRIQLLIKIPRDLRIHVCNKDIHTNGSGTTLEALEEGELGTLLRVPHAGNTDPEAVSEAEAPEAPRPSKRTRAAPSSPAAKCAREVPSTAATRKAEAEKKRLKLIDTSNRAQPDMNHFFKPSGSSGSQPSKILKKRTKPSPASIPVTPKVEVPPKASSTAWPDPKDVINLDDLPEEPTAETGHGESGKGASSSAPPPEKPTATSTEAPAEEVEKKFLLSRATGTPQTHPHLFPTLQKPPLSQRHAEISAMMDQVWGPANTEMKELSDLESDLKIFFAKHKNVRQRCVALPIRDLNLGANRAALPFTLPMVDLHDRLERPEYVSFPVLLSPLLDNLSAIKRYQIAKVYRRDNPSKGRYREFYQCDFDIAGVYEPMEPDFEVIKVLTELLDKLDIGVYEVKLNHRKLLDGMLEICGVPAEKFRTVCSSIDKLDKLTFEEVKKELVEDKGVSDETAENIGSLVKTKGPPLEVLLELRKEGSKFMQEREVTAPVTDLQGVAVFLQRQPVGAATASHHHTTVAVMILLMLKVMEVPGTDAAGVRPEAFAPCMLFKRTYHLPCVLGILRPDVNFLTSVKMDPKRIFKKMQISKLGDAQGIPLFINQHEVVSFKLNITHPHIEEMRRIREDPFLQCEGDTNIKDSYVLPDLNEHENEVANEPEPELEHVKKKQKTVKRGPEPATRCHSFVQIDDILDYIPSSNEYEFHGFLKDEDDDYFQPITMVPPKGRKSRRKKIPPRKWYDEKRLQPHEQLCLKMCFTNVQQFRNALIDLYIAQSRNYMYHRNSNIRIIVKCIKQRCSFLHNLAKAYKGRRVVEDVSLTVNSGEIVGLLGPNGAGKTTTFYMVVGIVPRDAGNIIIDDDDISLLPLHARARRGIGYLPQEASIFRRLSVYDNLMAVLQIRDYLSAEQREDRANELMEEFHIEHLRDSMGQSLVRG

SEQ ID NO: 102 - protein, 279 aa, Lolium perenne
MGWFASWRIKWPELAPHLAGNGDEFLGPLGLAGGVLARWMSSFVELLSSRPLPRATVGVSLGGGRPVVVDGAGPGSPVPRRRLCAGVKVSRSGVDERRCSCPDLVVLQLFPPLNQADADHGVCSGWLWWSDSRSESGRVPRRCVFILHQISASASGGFCGDINEVYSSKVSLRQHSCGLRGLFSFSGEVEALAKAVADHGEREIQEELAEMADWGPVVIATVLFVLLTPGLLFQLPGHGRVVAFGSMHTSGLAILVHAVIYFALITIFLIAIGVHIYAG

SEQ ID NO: 103 - protein, 1696 aa, Lolium perenne
MAECPGHFGHLELAKPMFHIGFIKTVLSIMRCVCFNCSKILVPEEDPKFKQALKIKNPKNRLRRIYDACKSKKTCDGGDELEAQDQQDTDEPVKKRSGCGAQQPNITVDGMKMVAEFKATKKKNDDQDQLPEPVERKQILSAERVLNVLKRISDEDCLLLGLSAKYARPDWMILQVLPIPPPPVRPSVMMDTSSRSEDDLTHQLAMIIRHNENLRRQERNGAPAHIITEFAQLLQFHIATYFDNDLPGQPRATQRSGRPIKSICSRLKAKEGRIRGNLMGKRVDFSARTVITPDPNINIDQLGVPWSIALNLTYPETVTPYNIERLKELVEYGPHPPPGKTGAKYIIREDGQRLDLRYVKKSSDQHLELGYKVERHLNDGDFVLFNRQPSLHKMSIMGHRIKIMPYSTFRLNLSVTSPYNADFDGDEMNMHVPQSFETRAEVLELMMVPKCIVSPQANRPVMGIVQDTLLGCRKITKRDTLIEKDVFMNILMWWEDFDGKVPAPAILKPRPIWTGKQVFNLIIPKLINLIRFSAWHAETETGFITPGDTMVRIEKGELLSGTLCKKTLGTGTGSLIHVIWEEVGPDAARKFLGHTQWLVNYWLLQNGFSIGIGDTIADASTMEKINETIGKAKNDVKELIKQAQEKSLEPEPGRTMMESFENRVNQVLNKARDDAGSSAQKSLSESNNLKAMVTAGSKGSFINISQMTACVGQQNVEGKRIPFGFVDRTLPHFTKDDYGPESRGFVENSYLRGLTPQEFFFHAMGGREGLIDTAVKTSETGYIQRRLVKAMEDIMVKYDGTVRNSLGDVIQFLYGEDGMDAVWIESQKLDSLKMKKNEFDNVYRYELDDENWRPTYMMPEYVDDLKTIREFRNVFEAEVQKLEADRLQLGTEITTTGDNTWPMPVNLKRLIWNAQKTFKIDLRRPSDMHPMEIVEAIDKLQERLKVVPGDDAMSIEAQKNATLFFNILLRSTFASKRVLKEYRLTKESFEWVIGEIESRFLQSLVAPGEMIGCVAAQSIGEPATQMTLNTFHYAGVSAKNVTLGVPRLREIINVAKKIKTPSLSVFLKPEVGKKKELAKNVQCALEYTTLRSVTHATEIWYDPDPLGTIIEEDVEFVRSYYEMPDEDIDPDKISPWLLRIELNREMMVDKKLSMADIAEKINHEFDDDLSCIFNDDNADKLILRVRITNDEAPKGEIQDESAEDDVFLKKIEGNMLTEMALRGIPDINKVFIKYGKVNKFEENEGFKPDNEWMLDTEGVNLLAVMCHEDVDATRTTSNHLIEVIEVLGIEAVRRSLLDELRVVISFDGSYVNYRHLAILCDTMTYRGHLMAITRHGINRNDTGPLMRCSFEETVDILLDASVYAESDYLRGVTENIMVGQLAPIGTGGCGLYLNDKMLQQAIELQLPSYVDGLDYGMTPGRSPISGTPYIDGGMMSPMLSPNFRASPITDAQFSPYVGGMSFSPIPSNYSPSSGGGYSPSSPVFSPGPGQAYSPTSPAYSPTSPSYSPTSPSYSPTSPSYSPTSPSYSPTSPSYSPTSPSYSPTSPSYSPTSPSYSPTSPAYSPTSPGYSPTSPSYSPTSPNYSPTSPSYNPSSAKYSPSHAYSPSSPRMMSPYSQTSPNYSPTSPSYSPTSPSYAQPSPSYSPTSPHTTSGGPSPDYSPTSPNYSPSASYSPTAPGYSPSSTGPQTTDKDDEIAP

SEQ ID NO: 104 - protein, 134 aa, Lolium perenne
MGYSSKRLHASILAVEAGQDAVIRMLLYQRADETVAPYRGHTVAEFTRRISDWRNGMSGCGAKDEGVKVLDRRQGAERRTISNILGAGVDSLGYQRTPAEALRILYGSRNEQVPGGFLPHGANGTIARGFFQLA

SEQ ID NO: 105 - protein, 252 aa, Lolium perenne
MAQSGSDAAPISTHPTEEEEVTVERTPEEEAARLRYLEFVQQAAAQAVVLAAAAYAYAKQGAGPLRPGVDHVEGTVKAVVGPVYDRYHAVPLDLLKFLDRKVDESVQELDRRVPPVVKEVPTYARSAAAEVHKTGLVGTATGLAKSAIARAEPKARDLYTRYEPVAERKAAEAWAALNRLPLVPSVTRAVLPTAAQLSAKYNSAVLDGAKRGNSVATYLPLVPTERIARVFSYPPTDAAATSAPEMQPIPTQ

SEQ ID NO: 106 - protein, 702 aa, Lolium perenne
MQEGGGGRAVRAGRYPPLASLVVSTIAAFSAVIVIAVLHSAYDDALSRTRTLLGHNLEPTPWHPFPHDKGRPPPRAALRCASYLACLPPLSQPRPAAAALAPNNASTRPRRQCPSYFSAIHRDLAPWKRRADGVGGVTRALLESARARASMRVTITGGGTRLHVDLYYACVQSRALFTVWSLLQLMRRHPGRVPDVDLMFDCMDRPAINRTEHSAEGAPPPPPLFRYCTTRDHFDIPFPDWSFWGWPETHIEPWSREFKSIRQGAKKVRWPDRVPTAYWKGNPDVASPLRLALLACNDTNLWRAEIMRQKKQWKDELRRLKEMKKRGKSDMDAYGYASIAGENDQDPPPENVSVPLPDMVLPPSFDCDNPTYRYRFLEPTSTVLARPVLDAHGWDHDCGYDGVSVEESLALLSKFPGTVAVQVTKDKKEFSIHLDSSISAKHGEDASSLAGFDIQTVGRQLAYILRGETKFKSIKKNKTTGGFSVTFLGDIVATGLKVEDQLSVGKRLALVASTGAMRAQGDTAYGANLEMRLKDKDYPIGQSLSTLGLSLMKWRRDLALGANLQSQFSIGRGSKMAVRLGLNNKLSGQITVRTSTSEQMPPNPMEEEDPESGESDPDHMHVIGQQWSGGVDRLAGGESPSSEVYSCASVMATKTTVATSDLAASGSGTVGVDDREVLMVKLGLREEDLDDIVLEEEGSQHE

SEQ ID NO: 107 - protein, 340 aa, Lolium perenne
MSEPDAKTTILGSSVFQFRVDYEQSKQLPIGKAVRSDVVSAGGHLWRVDFFPRGETDEDNGEYTSIFLSHMSKSCSVKAVFEAFMMGGNSKLSTSLNAGRTLETFEILGDKDFVDTWGWTRFIKRTSVQENFLTEGHITLVCAVMVIDDSPIPVPPSDIGTHIGRLLDETDGTDVAFIVDDKTFPAHRAVLAARSPVFKAELFGSMAESTMLSITLHDITPATFKTLLRFIYTDELPAEDDHQDSSTEMIQNLLIAADRYALDRLKIICAQKLWDKVSVDTVAAILGFAETYNCQELKNKCIDFFAVENNFKQVMFTDGYAMLLLKFPLIIAELKKRVGA

SEQ ID NO: 108 - protein, 275 aa, Lolium perenne
MLRLTLPCPSTLLIWQEILSWHRMTCRPPAQEISLTEWWIEARQRLAPATLLILWMTWKHRNSCVFEGAQPLINGLISSIKDETILWAKASATGLGVVTDDLGCSPWVILNRRFIEYCILGWENLPRVLLMYFNNVVLPQEGYFHSVICNSVDFRNSTVNNDLRYKVWDEPPQTEPLFLNMAHYDEMVNSGQPFARRFQKKEPLLDKIDDKLLRRPGHGPVPGAWCSGRKGWFVDSCSQWSDVNVVKPGPQALKLQQYINRTLEEANSGAKSCRR

SEQ ID NO: 109 - protein, 931 aa, Lolium perenne
MGAAELLSLCLVLAAVAWTEGQRPRAVKVGALFDYDSTIGRAAQLAIELAVDDVNADRSVLAGTKLDLITADTNCSGFVGTVQALQLMEKNVVAVVGPQSSVIGHVISHFVNELHVPLLSFAATDPTLSASEYSYFLRSTVSDYFQMRAIASIAYYYQWKEVTAIFVDDDYGRGGVSALGDALATKRARISYKAVIPPDANKDVISDILFKVNMMESRVLVVHVNPDTGLRLFSIANELQMMTGGYVWIVTDWLAAVLDSSKSGYPKSMSYMQGLIALRQHIPDSAAKKKFISKWNIAARKRKIASGLNSYGFYAYDSIWIVAHAIDKFLNSGQQINFSADTRLHDSDTSIITLSTLKIFDGGEHLLQQLLLTNFKGLTGLVQFDSDRNLVHPAYEILNIGGSVPGLIGYWSNYSGLSVAAPETLYQKPPNMSSSAQQLSTMVWSGGSTTKPRGWVFPNNGQPLRIGVPNKPSFKEFVASGKGPDNVTGYCIDIFNAAVKLLPYPVPSKFISIGDGIHNPKYDDIINMVANNTIDVAVGDFAIIKNRTRIAEFTQPYIESGMVIVAPVKQSTSSAWAFFKPFTLEMWCVTGALFVFVGIVVWILEHRTNEEFRGTPQQQVRTIFWFAFSTMFFAHRENTVSGLGRFVLIIWLFVVLIINSSYTASLTSILTVQQLVTGVTGLDNLIASTVPIGHPAGKFIRNYLIEELNIHESRLVPLNTIQDYADALNRGPKAGGVAAVIDEMPCVELFLSYHCNFRIVGQEFTKEGWGFAFQRDSPLAADMSTAILQLSETGQLQRIHDEWLTRPSCSSDDSGLGPSRLDLGSFWGLFLLCAMICLFSLGAFFVKISCQYSRYSSSVAAGESSEASPTSPAVSEVHPTKPKPRRLDSFKDLMHFVDKKEEDVKKEMKQRSSDKDNHGVGSSDTHFVSSA

SEQ ID NO: 110 - protein, 143 aa, Lolium perenne
MAPASTRAAAALHGVTLDNTDALDCRLCCLPLKPPIFQCKVGHVVCSPCRDKLGAARRCHVCRTATSGGYHRNHDMEKLLESIRVPCSNAAYGCAAKPVYYDRDTHLRLFCQHAPCHCNIEACGFVGSTLSALLDHVFAVHVE

SEQ ID NO: 111 - protein, 851 aa, Lolium perenne
MSTMKGVDDAFLGVGDKPGLDIWCIMGTSVVPIAKNLHGKFYTGNCYIVLSTAELKRGSRQHSVHYWVGEEAKEEHCVMASDKAFELDAALGSQAVQYREMQGEESDKFLSYFRPCIIPVQGSFSSHWRRSAEECDQTTMFRCEGEHVARVTEVPFSRTSLDHKAAFIVDTPLKIFLFSGCNSSVKTRAKALDVIKYLRENRHSGRCEIGTIEDGKLVGDSDAGEFWNLFGGYAPIPRDVPDAANGELMTTTSKKLFWINKRKLVPMDAHLLDREMLKSDRSYILDCGTEIYLWLGMATLVSERKISITVLEDYVRSQGRSSIGQTVITTEGHEIADFKLQFQHWPKNVVQKLYEAGREKVAAIFKHQGYDVAEIPEDKPQQSISSNGSLKVWLVDRGSVTLLCTEEQEELYNGDCYIVQYSYVEDGKDYNLFFSWSGQNSVQEDRLASVSLMSSMSDSVKGPAVVGQVSEAREPELFFLVFKSLIIFKGGRSAAYKNSVLQKSNRTEGYQKDGAALFRVQGLRHDCARAVQVDLIASSLNSSHCYILQDGPSFFTWTGSLSSPTEHVILDRMMNKLFPLKQSFLLKEGSEPDHFWKTLEGRSEYSKEKCVKSWPADPRLYTCTFQQCLFKAKEVFTFCQDDLATEETLILDCGEEIYVWVGLHSGVTSKEHALDIGKMFLQAGNAEDGRRSIFDTTVYAVAEGDEPAFFTSFFNWDNSKQVASVLGNSFERKLAILKGISPKLEAPDRSLRRSSSRRPGTSSEPTTPEQHQPAARRTFGPASASVGRVAKERSGASPALSPSPVTPSWSCEEPRLVLAVVAIHTVGSAAALPVHAARPLRYSHCEPRSTT

SEQ ID NO: 112 - protein, 626 aa, Lolium perenne
MDYTSDGDSELEAYGSDTYALLLSGDIQVMNDEGLYKCPFCSDEKDDYNKYDLLQHALGVGAAHDQQVKEKVDHRALAKHLKDDEPAKSHSPLLQPIVIDPQPPQHNRDDLFVWPWMGIIVNMPSEYVGKSANRLKEHFSRFYPVKVHHVYSKGRPTGNAIVEFGKDLVGFRNALTFENQFEKEGHGKIGWQEKQHGGPEPFGWIARADDYNAPGAIGDFLRKNGDLKTADGVEDEETMKNNKLVASLSFKVIETDMHIQELKSVYQERTASLKRMMEQREQQLQSYNQEIQKMQQLSVEHTKTIVDENKKLSLDLQSMTHELDARSKQIDELAAQTDCDRKNLELEKQRNAMKFNHLTLAEREYQKADENVLKLVEQHKREKETALNNIKKLNEKLHLTHKLQLDIKHLTGKLEVIKLTPGNETSESGKRIAELTEELRDKIEEMDYTENYNQDLIVQEKKTAVELQEARKLAIDAIQRFPGQTIDKAHIGIKMIGELDLKAFSNVCRQKFPKDDAEVESVKLCSKWQNEISNPNWHPFVAAMLNGKESEVIREDDKKLQELKEEYGEEAYAAVTTALTELNEHSSSGSRVPFPEMWNYKEGRKAKTKEIVQHVIKLAKASKRGR

SEQ ID NO: 113 - protein, 84 aa, Lolium perenne
MIGMIDGRTELKPAPETSAGDMRQLQVLNVLVSGEVADLESGYVTDGTPLIVRTYLILEITVMAAKIAYENAAFVENVVNNVWK

SEQ ID NO: 114 - protein, 431 aa, Lolium perenne
MAELNYIPNRVAQQLAGKQSLLIGVATSSLALHAPSQIVAAIKSRADQLGASVVVSMVERSGVEACKAAVHNLLAQRVSGLIINYPLDDQDAIAVEAACTNVPALFLDVSDQTPINSIIFSHEDEHRHALGRRLETWKDVVAVLAAVEVVERRVPLVAEVRADVALHLVEQVQVVHQFVENVAAAALNEDGAVGVGVRVDGAGGALPAHVAGRCVRGAGIVEAGDAAELVFKAATSLDSVLWTTMISAYGKSGRAQDAVSMFDRMAHLGIKRDGVAYLAVLSACSHGGLVREGWHYFKVLFDGQSSVKLQPEHYGCMADLICRRGCLQDALEFIESMPFDSSVAAWSALLNSCRIYRDAKLGQLAASRLLKLDPGNHSNWVALSSIHALEGDWHETWMIRENMNKEWVNFFFIIIISFYSTAMVITYMAAR

SEQ ID NO: 115 - protein, 664 aa, Lolium perenne
  misc_feature (128)..(152): Xaa can be any naturally occurring amino acid
  misc_feature (193)..(205): Xaa can be any naturally occurring amino acid
  misc_feature (344)..(363): Xaa can be any naturally occurring amino acid
  misc_feature (401)..(407): Xaa can be any naturally occurring amino acid
  misc_feature (492)..(492): Xaa can be any naturally occurring amino acid
  misc_feature (533)..(543): Xaa can be any naturally occurring amino acid
  misc_feature (610)..(610): Xaa can be any naturally occurring amino acid
PPHEPPPTGPVAVAVAASNIRPQNPSPATSTAAPRHGHQRQLPEGRRGEQPGQGEAAAVHGVREVPAAGSPAETIDATEMEKMDNIGPNIWKDGIQTSEENCCEGIHFICCKHHYFVSCKFSRNAKVXXXXXXXXXXXXXXXXXXXXXXXXXSLNTNFDLHILSKFSLFNHFKPRSGMPKYDGCCFYIGTPQXXXXXXXXXXXXXITFFALKLLVLPKLGYLHCMQHSYYKHIKRQIRWLGMALLLHARLRRQLLMLTQLLWRPRRMLHRFQGQLLGWVQIIQMRVNLMIPSRRRSEKMRSCSIWLRTSVLGTLQFGKQTNQRLQRLQRQQLLQLIHWMNRDDXXXXXXXXXXXXXXXXXXXXEAHMWRTELGKAREQAVIQEATIARAEEKVRVSEADAXXXXXXXVRIKEAAENLHAVEKEKEELLALIGVLQSQVQRDQSSTKQVCEERSESCSGADNSPPLTKHVDASDDDVDKACVSDSRSVLVSSXHRSPACCGWGGHPSNWRCRMGLPAARSIDRCPGSLPGRRRXXXXXXXXXXXTSPSYAGRGNTSLKVLELPHTFLGGCDYGNCQGFESSRELLSQVFALLPGCMSIVFKYATQKMLRVXLCDCKLFTSSPSAIIWLSVHDNCDVKVCLEVQQLDISLWNKRKSKSCACLVWML

SEQ ID NO: 116 - protein, 718 aa, Lolium perenne
MLHELLLALLGFTGDFVIDNSSSSSARRRPSPAESVAAGDADAGPAFRLAPDLTFLQPSERSAIERLISLGFYYRELNRFATESRDLSWIQSSVDVSSPNADITLKGKVRKGSAYRRAIGNGIAEILSVYRSAVLQVEQNLLSDPLPILATVTHGLNKFEVLLPPLYELVMEIEQKDIKGGQLLNLLHKRCHCGVPELQSCIQRQVDRDEENESAQSDVADKFAQKLAKDTSLTSWHSGFHVSLDMLPEYIHMRVAESILFAGKAIRVLRNPSPGATLQEPANQSQILKGSHRMQTFTGGSGALKELPNFSNISAEELLPQVEADKVDAMLKQLKHSSEFHKRLFESAVSSIRTIAANHLWQLVVVRADLNGHLKALKDYFLLAKGDFFQCFLEESRQLMRLPPRQSTAEADLIVPFQLAALKTIGDEDKYFTRVSLRMPLFGMKSSTSQKDLQKSNTPDLSSQGKASSELALDGWHSIALEYSVDWPLQLFFTPDVLSKYRKVFQYLIRLKRTQMELEKSWTAVMHQDHVDFSDYCKDRKNSSATQLRRLRTKPFWRVREHMAFLIRNLQFYIQVDVIESQWNVLQTHVQDSHDFTELVTFHQDYLSALISQSFLDIGSVSRILDSIMKLCLQFCWSIEHYETGANMFEIDHITEEFNKKSNSLYTILRSSRLAGSQRAPFLRQFLMRLNFNSFFETTARGVMNSGRLRPNTAGTQL

SEQ ID NO: 117 - protein, 818 aa, Lolium perenne
MGQQVFAEHPPVSAAPGAHPCPYVAYLQPLPSLASSSSAHVPERTMDGSVYHDHWNHLAGPSDGRPLHTVPPTDFHHNHWAHLPHSYAQPNSNNGLTEQPGVPFGTMRAARADGDIQRRGSVISPSYFSNGSGSRSRAPNVPPLVPQFMRGHGNINEQYQQNPSSSLFAGAHRSGGMRSAPPPQPENPTFCLFPPGSSGHSSMETDDAGGSRFYAWERDRFAPYPLMPVDCETSWWSSQQSHGASESTAAPAPAPAPRRLFGQWIGLGRGAATLGILQQLHPWRMIPMISIYAEDIMAIKEILNLFWRTSGLQVNFSKSSATLIHCSEEDTDAIGQHFRCPSVQFPIIYLGISLTARKSTAAQMQPLIEKARDNLPTWKARLMNKSGRLELIKSVLSAIPMHQLLVLAPPKKSTKQLEKNRAWISLDCDLERAGLTLRLRWLWYSHTDMNRAWSNLELQFSAEEHTLFFTSTSMSAGNGQTALFWDDRWISGRSISEIAPQLHACRPKRRWKAPETMLRLTLPCPSTLLIWQEILSWHRMTCRPPAQEISLTEWWIEARQRLAPATLLILWMTWKHRNSCVFEGAQPLINGLISSIKDETILWAKASATGLGVVTDDLGCTLVSFPLFFSRTRRKSPSHFIKLEKEGSPWVILNRRFIEYCILGWENLPRVLLMYFNNVVLPQEGYFHSVICNSVDFRNSTVNNDLRYKVWDEPPQTEPLFLNMAHYDEMVNSGQPFARRFQKKEPLLDKIDDKLLRRPGHGPVPGAWCSGRKGWFVDSCSQWSDVNVVKPGPQALKLQQYINRTLEEANSGAKSCRR

SEQ ID NO: 118 - protein, 407 aa, Lolium perenne
MKVHFSAKLLSGPVPVYLLALAVLILLTHAHYMGHVGVGVPPAAKLEEPVVSVMKQCDIFRGEWVPDTAAPAYSHKTCGMIQEHQNCLKYGRPDLGFLKWRWRPSGCELPRFDPAQFLRFARHRSLAFVGDSLARNHMQSLLCLLAQVASPKDISPDPSDQQNKVYHYRAYNFTVAMFWSPFLVRAREPAHDDPAHTAHYSLYLDEPDERWVSQVPRFDYVLVSAANWFSRPSLFYEKRRLVGCSFCSRQYGVPDLTLHYSHRKAWRVALRAINALDNVTGRVIVRTLSPMSHFDNGTWDQGGDCRRTEPLRSNQTSMMDGRGPDHRFYAAQMEEYRAAEKAARAKGTMRLMLMDATAAMLMRPDGHPSRYGHRPNDKVQLYNDCVHWCLPGPIDIWNDMLFQMILV

SEQ ID NO: 119 - protein, 1687 aa, Lolium perenne
MAPKAGRGKGRGGGGKGDRKKKEEKVVPTVVDLTVTTPYDSQVTLKGISTDRVLDVRRLLGSNVETCHLTNYSLSHVVRGHRLDDGVEIVALKPCALTIAEEEYATEEAAVAHVRRLLDIVACTTAFAKHKHKSSPKHARPATPPSPPATASSPAANGGKGDGAEAPAISEAHDMAAIGPPPKLGEFYDFFSFAHLTPPLHFIRRKEKNGAAQEGDYFEIEVKVCNGKLLHIVASVKGFYLVGKPHTAYEALMKAFVDHNKFGNLPFGFRANTWLVPPVYMDSAAKGPALPVEDESWGGHGGGRGRDGKHDRRRWAKEFSILARMPCKTEEERVVRDRKAFLLHNLFVDTAIFRAASTIRRLIDTSVRTGSDGSLVFEERVGDMHVTVKKDDADASVKLGDKVDAAAVYQTDAMDISQRNLLKGLTSDESVVAKDSSTLGVVIVKHCGYTATVKVSGRTKNSTDSKQPSDISDHLDGVLNIDVDDHPDGGSNALNVHSLRIPLPKIINPEVAASNQHLSSKTHVDNYARKLARTVLEASLMKLENMQKENPRLIRWELGSSWLQHLQKKDSSASGDSEKSTKKVEKDSSVKGLGKHFEQLRKLKKNVEGAKTEKEDSDSNCSLTNGMEESDNKAFDETSEAELRKLMTEDAFCRLKSLEAGLHQKSLEELTKMAHKFYDDTALPKLVADFASLELSPVDGRTMTDFMHTRGLNMCSLGRVVDLAEKLPHIQSICIHEMVIRSFKHVIRAVIASVDDMQNMSAVIAETLNILLGSPRLDNDLDTDAHNEHNLRLKWIESFLSKRYCWKLKDEYEHLRKSIILRGLCSKVGLELVARDYDMNSPNPFDKSDIVNIVPICKHVVYSSIDSRNLLESSKMALDKGKLDDAVNYGAKALSKVIAVCGPYHRLTANAYSLLAVVLYHTGDFNQATIYQQKALDINERELGLDHPETMKSYGDLSVFYYRLQHIEMALKYVNRALYLLQFSCGLSHPNSAATYINVAMMEEGMGNVHVALRYLHEALKCNKRLLGADHIQTAASYHAIAIALSMMDAYSLSVQHEQTTLQILQEKLGEDDLRTQDAAAWLEYFDSKALEQQEAARRGIPKPDSSIASKGHLSVSDLLDYISPDQERKERDMQRKCRRAKNNTRAQQGESVEEKENFQDDSGSLLEAVKNDFQEAKLEPQAPVVSVVTEEICAVHDELKQVEALSPEEYSDEGWQAATLRGRSANVRKKSIRRRPALTKLAVGRIEDGRTASAQRTDVQPQTKEHKEEATYSPSQLSFGNFFNSDKLNGDPVLTEDKSCNATSKSEQSIKPTGINRPTSIASKLVSYKDVAASPPGTVWKPILEQKEAKEKDTEEVIDVTPSSEEDGKVTDEVEKSSDEGSKEIVSSQPEGGSHSEKASDSDGSTSPNKKTSGSKLSASAPPFNPGSLLSVSHPYSTVAIYDASVVLQTIPSQAMEIFPHAVDTRVPRGPRSTLYYRTGHSFQRKQGYTQSQSTIVRGSTSPPAMNPHAAEFVPGKAVQQTDLANGKHVADSADQQLTPQTSDEVKADIHAADKAGQVEKITPGKGKENRGKDAMRDSYKAELARQILLSFIVKSVHDSLGSTRAQPDRKPSAPDEPSNEQSSNITKPASARKEFDKQPKAAEVLKSEKDTEGFTVVSKRRRSKQHFMNPINGLYSQQSICTSVS

SEQ ID NO: 120 - protein, 206 aa, Lolium perenne
MSSSSSRPPTTPRGAAAAAAGCADPNTTFVQADPATFRALVQKLTGAPGGAPAASVEKQQVSGTIFPAVPLPLRRPKLQERRRAAPARLELARPQPFYYHPHHHNHHHHHHHHGIMQYSPVSTMDYAHALAASSSASSPSPSPHSSCSCGVVISKEEEEREEKAIASKAFYLHSSPRSSAVAGGDSERPKLLPLFPVHSPRSSSFA

SEQ ID NO: 121 - protein, 226 aa, Lolium perenne
MSSAPPPPAPPSRSSNPEAPPRVVRPPPRRPPRAPGPPPWAERRPSVSVDYDRGRRTARVEVDGVGADALPSRHRLRVEGSRWQRDWKVSQVAARVLALPPADAHAVDAVLNCWAGRFARRNFPLLIREITFTGSLQHAVHVFRWMKNQENYCARNDIYGMMIRLHGRHNLVDQARGLFFEMQEWRCTPDADIFNSLIHVHARAGQWRWAINIMDDMLRAAVSIVL

SEQ ID NO: 122 - protein, 287 aa, Lolium perenne
MDRGRGSDEMIPGVFFVGHACLEVAAPAGRTFDLGTPDLEATDRILRTAPPPEPEATGRTCRGDAGPEADVDVAGRALAVVERDGAHDPATGRALTGSWLWDSALVLTNHLASAEPSQLLGATVLELGAGTGLPGIAAVACLGAARCVLTDVRPLLPGLRANAEANGLDLDTAQADVRELRWGEEYDLVMLDREVPCVDVVLMSDVFYDPEEMPAMATTLRRLWRDGTVCWAASEVRCGVQDCVDVLREEGFDVAEVDRVTRPLLRAPSQNADFAVYRIELRRSREG

SEQ ID NO: 123 - protein, 414 aa, Lolium perenne
MGSSLKYRAGLVLIGAVVLIWVTSAEVTQEIFADYKQPFAITYFGASLMVIYIPLAFLKDFIYKLLRRHSGSSRASKVVSKSSFGGSAPLKNGEFEKMLEMEPQKTVVIDFTDVDIPVLEEAKPLICGIGEFGDDVLKEQQLSTKEIAIYGLYLCPIWFVTEYLSNAALARTSVASTTVLSSTSGLFTLFISVLLGQDSINAAKVIAVFVSMAGVAMTTMGQTWATDESEVSNSGTYRLANHLILKPYYCRATQRTLLGDMFGLLSAVSYGLFTVLLKKFAGGEGSEKVDVQKLFGFLGLFTLCLLWWLVWPLTALGIEPKFTMPHSAKVDEVVLANGLIGSVLSDYFWALSVVWTNPLVATLGMSLTIPLAMVADMVIHGRHYSAVYIIGSLQVFSGFVIANLADRFSRFLGL

SEQ ID NO: 124 - protein, 582 aa, Lolium perenne
MTSPSAPPPCPHLAAHRLTSRPLRFPRRCLRVRPLGRPEIRRDAREVPRCSPCASSSPPPARLYACLSCASVFCPSHAASHASSSPGHQIAVDVDRAELFCAACGDQVYDPDFDHAVVLAQSTALSPPSTSTPSPAPRKRRRVDYRAWAPDPAESALVSAAADPTTSASTTDPAGLRGLNNLGNTCFMNSVLQALLHAPPLRNYFLGDRHNRFLCPRRTPMRHRATDADAKAACLACDLDEIYSATFSGERTPYSPAKFLYRSGSQALFALVHVALSFQQPAVLFYAGWWQHATNLASYEQQDAHEFFISILDHIHENIKDDEHKSHEQGHGDCCIAHRVFSGILRSDVICTNCGFSSTTFEPCMDFSLDLDAGCNGSRGVANPKARNGERNLAGMNPKVSSTLMRCLERFTRAERLDADQKFFCERCKERQESLKQMSIRRLPLVSCFHIKRFEHSTVKKMSRKVDHSLQFPFSLDMAPYLSSSILRSRYGNRIFPSESIDSEAVSELSSEFEIFAVITHSGKLDAGHYVTYLRLNNQWYRCDDAWVTRVDEHTVRTSQAYMLFYVQKTLYYKACEKPAAV

SEQ ID NO: 125 - protein, 295 aa, Lolium perenne
MVRALSSSPVSSFANALPGVPARRSRHGLGHPESQMPNINDEDEDTGPFVPTAPRHPPDRSMQPPTPLKSAPLGRGRGHPIMPAAPRHSPIILSLTESPNGELEPRRRRCSVSPRFRAGEANHRLTVDREFEDLEAHSGATDLESGADEEDQDQAAHRRGCCRCCMVPGSASSSWAAGEAKNSTYGTGGFILLNTRDEVTQPSHGLLSTIAYKIGPYVTTNYVLESSIAIAGPVVKWLRDSLEIISAAVEIEILAGSVQDSDSGFIGDGLLQDANRYNIQEVINKGKLQCRLFRH

SEQ ID NO: 126 - protein, 521 aa, Lolium perenne
  misc_feature (472)..(472): Xaa can be any naturally occurring amino acid
MRCELDYYWSLGEVSDNGGVSCVIYKVQEHIRMADKLSYEPCVLSIGPYHHGAPALQTLQKDKWSYLDFILNLNTDKTLQDYLLALESLSKVARSCYSEDIEMDAEEFLQMLLLDGCFVLVALGGTKEILAAAKHIKLDKLKSEDTPENISNPNDAFNGTDETNNESMNQEGGEDGKLQAEHRTQYQDEFGQWFYRFLVHDLFLLENQIPFFIVKKIFNVVASDNILDDSPFTHEISRYVDAALRWFPKSIQESDMPKDFDNLLQLCHMYFRPSRTAEDYSYQLGKQYFNRFLSFGLKYLKIGQYHDDTEEYSSYNLEIPYLQDGQQLSRWRRAAQYLEAGVKFKKREHDQLHPHSLLDVKFSNGTMEVPCIVLDEFTGALFRNLIAFEQTCPQFGDDFTAYIVFLSQLISMPEDVTLLARREIIVHHLDSDETVSDLFTMLSKDVVFDFNGQYYLKSLCQMMETYYQSRLXRWMAWLWLNHFRNPWLVLAAFATAVVLVCTVVQTVYGVLAYIHPPGSNK

SEQ ID NO: 127 - protein, 390 aa, Lolium perenne
MGRRGGVLFVVGGGDGVARRRDGEAAPRGGGDGGAGDGCVLGRGSDGFLREENSGGGIANYMVVDYYLYDYEYAEPPRVTSLQNAVPQRTFSDFGDDVYFVADKRGYESVVHYLAGQYLNTDDSGNVADPRLQLNKVVREISYSSSGVTVKTEDGSVYQADYRHGLCQLAISHPTHHSANYSIILLTFAMSIDLQAWKIIAIYRFDMAVYTKIFLKFPRKFWPTGEGKQFFVYASSRRGYYGMWQSFEEEYPGANVLLVTVTDQESRRIEQQPDNTTMAEAVAVLRRMFPDEDVPDATDIYVPRWWSNRFFKGSYSNWPIGVNRYEYDQLRAPVGRVYFTGEHTSEHYNGYVHGGYLAGTDSADILMNSIFNNVEFKVRGKYHDQTAEAK

SEQ ID NO: 128 - protein, 264 aa, Lolium perenne
MAEADDAAAARRRTVVTDYRNKLLNCRELETRVRTELELDRGKKSDYPVSRSARENLKKAKKDYDKTEDDLKSLQSVGQIIGEVLRPLDTERFIVKASSGPRYVVGCRSKVDKEKLTAGTRVVLDMTTLTIMRTLPREIVSSAIIDKYIGESARLIREMFNYAREHQVKMIMATNRPDVLDPALLRPGRLDRKIEIPLPNEQSRMEGFNGADLRNVCTEAGMAAIRAERDYVIHEDFMKAAVRKLNDAKKLESSAHYSADFGKE

SEQ ID NO: 129 - protein, 1087 aa, Lolium perenne
MTKLKSVASTVGAAEECAGSARQIAPSPMKLLVRVVEARGLLAVHVNGTSDPFVKLQLGKRRAKTAVVKKNLAPVWDEEFSFLVGDVTEELAVSVLNEDKYFSNDHLGRVKVPLSQVMDTDGLSLGTAWYQLQPKSSKSKRKCRGEICLRISLSTRTHVSEELHPLPRPTSDGVSSSSDRSIGTKRGALSTTNSYIDLSAVASLDRGSQSSFERSADSFVEQPPRSSIEQAVTEPGTAAETDAMANTSSMVEVLSRYFFRKPVDAAVAAVVSDAESVVDQSPEPKACSEEREGPENRTPPESSLDELLKIMESKDQGAEMPAKLSNGVLVDESYVTAPAGLNTLLFSPNSDFWPAVAELQGTSGFQIESWKIDSNDGCLRRTLSYIKAASKLVKACKATEEQKYLKAAGNSFAVLSIVSTPDVPCGTCFKIEILYSITPGPQLSSEEQTAHLTVSWRINFVQSTMIKGMIENGAKQGMSEGYAQFSEVLSQKFKVAELDDANASKAKILASLHTQKEPSWRLIVRFLGNFTFIVSVIVGIYIIAHLHLSKPKAMNGLEYFGIDLPDSIGEVVVCAVLILQGQNIMKVMKRFSNAWKQRGSDHGVKAHGDGWILTVALIEGSGIVAGDSSGLFDLYAVFTCNAKRKTSSIKFHTSDPKWNEIFEFDAMDDPPSRMDVAIHDSNRSDGDPIGHAEVNFLTSSLSDLTDIWVPLDGKCDPASNPKLHLRIFLNNSRGTEVVMNYLSKMGKEVGKKINLRSAQTNSAFRKLFNLPPEEFLIDDFTCHLKRKMPLQVIPPTLSIGSPSLMVILRKDRGSEAKHGAKGTDNNGRLKFHFQSFVSFGDAHRIIMGIWKMRSPGPEQKGEIMEESELKELPAEESGSLFSHEDVKMSEIFSSVLSVDKYIPAANQINYKFDKALSRSGGEASTTQQKYALVNQDGWAIEEVMTLQGVLLGDYFSFDKPFSRYGGEATTTQQTYALVNQDGWAIEEVMTLQGVLLGDCFTLQLQLKYHMANVPPKPNTCSVQVLLGIAWLKSTKQQKKVTKNIMSNTSNRLKELFSEVEKDLTSRNGTLFSASIDPYRSLHDPNIT

SEQ ID NO: 130 - protein, 272 aa, Lolium perenne
MAAITTTTAPSSFRISSSPPPTTSTPRSNLTFHARNRCHSRLACRATDVSGAEPSAPPEAGGGRTWVPVVPLAALPRGERRVIVQDGDEILLLWYKDEVFAIENRSPAEGAYSEGLLNAKLTQDGCIMCPSTDSTFDLRTGEIKEWYPKNPVLRALTPVLRKLFVYPAKTDGENIYISIRGDGASVGSAEILFSGKAQPGSTASDVNIEEVRMVVDEGVGGFGFTPYNELINGRAAIIGFLLLIDFELLTGKGLLRGTGLLDFIYAISRAFS

SEQ ID NO: 131 - protein, 1014 aa, Lolium perenne
MGSLSPWGQFSLVPFLLLQFMLHVSYGCSVEERAALLEIRSSLMRAHSLEVPDSWRKDDHDCCSWKHVKCNNKTQRVSHLDLSSVYATTEGDGHWFLNSTVFSVFHELQYLDLSYNSPCSLSLKGLVGLAKLRYLDLSGTMWGVGFPEFIGEIVSLEVLALNDNNITGGLPGTAVKNLRNLRQLNMTSNSCDGNLPESLFSLPHLKILDLSANIFGGHIPISSASQPISLEVLDLSSNHLNGTLPVAAFQNIRNLNLSGNQFRGSLHVSLFALPHLKFLDLSYNNFEGRFPVSLSPEPVPLEVLNLHYNNMSGALPSEQAFENFKKLRGLYLSSNQFSGNIPAFLFYLPHIERLNLSTNIFSGPIPINPSLNLPLSLKSLRFSQNNLSGRISFIWLGNLTKLEVIDLSGNANLVVDVNIPGWTPQFQLKQLLLSGCDLDKSIIAEPRFLHTQHHLEVVDLSNNNLSGSMPNWLFTKEATLQYLNLGNNSLTGLLDPIWHTQSFLYVINIHMNHIAGQLPANISSMFPCLSVLDFSNNNLLGHIPSSLCEISLMQHLDLSNNKLSGEVPACVFTNYPMLMTLKVSNNKLGGVIFGGMNNLSIMSELCLDGNKFEGTISHDLSGVLEIMDLHDNELSGRLDTSLWNLSSLVVLNLSGNRLTGKIYPQICGLAGIRLLDLSSNNLAGSVPNCSFLLLNFLNLSGNSLSGDISYSFFNTSSLVALDIRHNQFTGNLHWVRYVGNTRLLFLSGNKFEGQISPNLCKLLYLRIIDLSHNKLSGSLPACIGNISFKGETDDQIFQPVHRFISYFYRNFYAPQKYSNSYDFKSFAFATKGNLYIYGRSFFLSMSGIDLSANMLDGEIPWELGNLSRIKSLNLSYNFFVGPIPATFGGMKEIESLDLSHNELSGLIPQQLTQLSSLGVFSVAYNNLSGCIPNSGQLGSFGIQSYLANTNLHKITHGNMCTAPGLDPAPEEDVGEMFGDPVLYVVTAATFVLAFWATIGFSFCHPYGRSVMLKL

SEQ ID NO: 132 - protein, 673 aa, Lolium perenne
MKKLGGGGIPQDAGLSDFLKNRLQKIPRISAPTQLFLGPPLHRSRTVETPCGGKIPSSEEFSLILPLLAVSRLSRTNSLRTESVESPVPDAFAALPTADADEVGTSSSTAGGGATASNPISPRSSNPLPSTTSATTPLELPGVPPAASARNPKIHHTRGVLHLYRSSPSLPASSYASAVAVAATPSSSSSGPTAPPLQCDSLLPSWRGTRLLVLAVPTRVSPEDFVRFCGPYVEHASEIRVISDDGVEDRYSVLVEFEDQKSADGFYLDLNGWRFSSSEVVILPIWCQLVEVCHVLFIVAVQYMPSAVPPVGSTELPTCPVCIERLDQDISGIVATNCDHSFQCSCVSMWVSSSCPVCQFCQKQSETPTNPTCSVCQTSENLWICVICGFVGCGRYKEGHSIRHWKDTQHCYSLDLETQRVWDYVGDSYVHRLNHSKSDAKHSKLRSKCEFSGDNDDLDMGGVMFSSKTDTIVDEYNRLLASQLETQREYYEALLSDAKKDREHISVAVDKAVNDKLQEMQLKLENTMLEKKKVAEMNEKLMKSQDIWSKTVKGIEERERAQLRLKDDTILDLEEQIKDFKYSIKLQKSIEKSTHADDLKGGMLVPLAMESESGKGAEFEHYVNMCKKDHEAPYQKNLLPSRKNSDSMEKLLIPPKTTPPSLLFDTLKVKSMG

SEQ ID NO: 133 - protein, 204 aa, Lolium perenne
MSKLTVGVCIMVALSLAVFLTIVVLLLADLFCSHLRLRRLRADAEMAPHKRPKLGVPASSPPHTADDASVATTTTTATHEALSSTPPFYYAHGVMCAPTRKDLLLAIPKLEAAVWKWSPARRSSPSPSPPRSEPTARESSSSAYSDGFLRISNPVYERGATAAPGGYEEDTPFDTPDASPSPNGITEEEGAFGRVNHTHQGARS

SEQ ID NO: 134 - protein, 192 aa, Lolium perenne
MRGSLSYQVSISGHSRGGKVAFALALGHAKTSLPLAALIAVDPVDGTGLGNQTPPPILTYKETPLHVPAPIMVIGTGLGEVPRNFLCPPCAPLGVSHAAFYRECAAPACHLVARDYGHTDMMDDVTTGAKGLATRAVCKSGEAREPMRRFVGGAMVAFLKKWVEGRPEWLDGIRERPEVAPVVLSVVEFRDE

SEQ ID NO: 135 - protein, 80 aa, Lolium perenne
ERTQYRNPSCSNSWKRPPVEEVFCKLVTHYARVHSRQCLDEAEVAEHVVGLTSSLANCKFSYSVPSLLFRHLNHFYHSRV

SEQ ID NO: 136 - protein, 101 aa, Lolium perenne
MAFKKVQMADKYPKGQSRGRQWKHLRFLLQAADATSLPPDRPNYLNIQSPPSIYPPKRYCDVTGFEGCILGTKGIQDGRGFVEFLLFTQSPLYKCGLVIRD

SEQ ID NO: 137 - protein, 1981 aa, Lolium perenne
MALEKESIRKDSFSKEQIQYTREGTGGTPSTHLDLQAHLEKIARLERSLQGLQEQLSFAQAECFDKDVILAKQAKVAEEAILGWEKAEAEAIATKTELDDTLHQKATVEQRICQLDEALNVTMVERELLIKDTAKIISCEKDKVHKLEENLEEKQNIIASLDDEYSRLSEILLAKEKVILDLTELNAVKESDLKDLVVKLESTERSNSSLRYEVCMLQKQLDIRSEERKCNLKSADASHKQHLENVRKITKLEEECKRLRSMVRKRLPGPAAIAKMRSEVETLGNNIAQTRMGKLNSPASSNSYDPVQNFSDASHSSSSLLARLHVMEDQNKSMKESLSRKDGELQFSRTMLARANSKLSQVEAQLEELSGDQAATELVKRSPALAENPLSSISENGCNEDNVSCSGSWASALISELEHFKKGKLTTPSCQSTGVSDMSFMDDFEEIERLAMVCDNKPSKLYDAKREAIESAGKELVPVDGPNETNDQVHQYKIQKGLVKLIELVEGVIQRSSKDHNSKFVQSGDNMGDQSTAIDGYFAHAFLWKTSELTCVLRHFIVVCNELMYGNTDAERFVLEVNLTLDWIINHCFSLQDVPDMRETIINHLELDSSDGLDAVAAKQIAIQTTKGVHEPSTPNSVQMSLISVSSHVDIGLKADNDTRSITNEVPVSNPHELEGKSSSLRAELNALKETGKINAQSVNCESTVSDLDKHKPICNSEEGKPYFEFTIILQPVGIDKLIPCQLAPFVGTRGVKDPISMARLRSSTSSTASNAMDRGKQIATGLVDFVPHPPSRLDAYAYLEEPMEMTFGRFHFRVEKEGSYRVEIPISSGSSAVDSDFSSYTSSTESGEEETSSSRFISTRAREKLAKIFSDMSFESSADSYISDGSSSVNSYDFIDKSTTVGKVFANLHDGVTKPNIDLNTKYHHIYVIGEPSRDQEETSEAFDDLGNPYVDPSDLRRGLGNKYIGPQPRDRVQLPQAAWDRAARAMDGSEPMATTATPEELQAYQYRLARAARELEKQTAELNRRKEAASASNKTLLDTSCSGSFTRNKEEFKRDLLDRIQENTEGWENDKDRESGFMDTDKFRNMSATYGLDSQVAANLYKAFASHYELPKKNFDKYHEPYKDKIDSSINKCVVVETADHVIPEAYIEKTPFPAKMKEYSVINSAVHKSEKKPVEPEEQIKVEPAVAIVKDLVTENVEDGHIIFCEDASNIVSHPNKPKQVSVPMLSVRIGDHCYYGLCDIGASVSAIPYELYTEIMHEIDSCELEDIDVVIQLANRETISPIGIVRDVEVLCGKIKYPADFLVLGSAASDYCPIIFGRPFLNTCGAIIDCKKEKILTKFAGESYEFNFSKFTKTPYKADLPSDDFKMEQCASIILVPNNPLQQHLENSESEVFRKERDELEEIFLRQPILKHDLPVEDLGTTPPPKEDPVFDLKPLPDNLKYAHIDDKKIYPVIISSKLSEIEEERLLEILKKHRGAIGYTLDDLKGISPSICQHAINMEDDAKPVVEHQRRLIPKMKEVVRNEVLKLLEAGIIYPIADSRWVSPVHCVPKKGGMTVVPNDNDELIPQRVVVGCLRNLDKVLQRCEETNLVLNCEKCHFMVNEGIVLGHKISERAIEVDRAKVEAIEKMPYPRDVKGIRSVLGHAEFYRRFIKDFSKISKPLTNLLQKGVPFVFDDDCKEAFETLKKALTTAPIVEPPDWNLPFEIMCDASDFAVGAVLGQRVDKKLNVIHYASKTLDAAQRNYATTEKELLAVVFACDKFRSYIVDSKVTIHTDHAAIRYLMTKKDAKPRLIRWVLLLQEFDLHIVDRKGADNPVADNLSRLENIAYDPVPVNDSFPNKQLAVIKVSSRDSPWYADYANFIVSKYLPPTFSAQQRRKFFYDLRHYFWDDPHLYKEGVDGILRSSRLRVGLFMHVIMVKWTDRSAMLRADRRSRETTSCEYMLYSVKSYTSLSPPSVHVAKDLYVGRAERLALYELS

SEQ ID NO: 138 - protein, 511 aa, Lolium perenne
MDMDRIRYTNNIDDGGEIKAPIPYDEQPESFPSLNASLGNFPLMPEDIDQRSGSSLDGRRLACKRKTIEGAHGIFSAGASTSFSHRNDNVFHNIPSTSFSPAPTMNVPSHNFLLPPSSIEEQLPHYGATTGLPSSSYNHPSGGNYNSGNSQRSFRVRTTTAQQVNPYGVWPSSSTMSHSSSWNHQAPALQSAFDEMQEGIPMVSGINLQYQHPANVVPGIPQIAHRFACHGASSSRAGSLDNRILGSEDVTGRSVAAPNFSNAAPLAGIDMRPLVPEPSTWNSDLRGTAIPGNVSSVSRANPSSIVNRPAGSPSVAHPTLHRRHPRNLSEEIGRLSGALRGQQQPRLRSGFLLERQGDGVWGVPLPMRSSREGRRLIEIRNALEMIQRGENVRFESIFYGGVDIHDRHRDMRLDIDNMSYEELLALEERIGNVSTGISEDDVMKLLKQRKFSSWRLASMEYEPCCICQEEYVDGDDLGTLHCGHDFHAGCIRQWLVVKNLCPICKNTALKT

SEQ ID NO: 139 - protein, 209 aa, Lolium perenne
MAPLAAAAAAVAAKEELGVTVAVAPPMALAPLSQQQPRRQYRGVRMRKWGKWVAEIREPHKRTRIWLGSYATPVAAARAYDTAVFYLRGRSARLNFPDEISALAPLSPPPEELEADGGALSAASIRKKAIEVGSRVDALQTGMTMVATAAAPATNHRERQRQHHAQQQAARDEELLQLHHQKQQRTAWNGRAKNPDLNQAPDPDSSDAE

SEQ ID NO: 140 - protein, 649 aa, Lolium perenne
MRKSNWCWPRRFCMFVAKKKHCQALKLENPAGNDSPVGPMQGEHTETFVAIFAAKKEHYVCSIVVHFVVTVVVPAAGCVVKHLHAHHLDALVGECEYAASRLGGRGTGRTSPGRCGVEPEEVGERPRHQTRQEPEEGGSSPAMWDLNDSPAADAPHAPPLSPSVDDSGASSSSAAAVVEIHDDGDDASAAAAAEEPMFTRQFFPPAVPGDPAPGNGRAAWLRLAGAPPPAAAAASAAAPGAGAGPAAAAASAANKKSRRGPRSRSSQYRGVTFYRRTGRWESHIWDCGKQVYLGGFDTAHAAARAYDRAAIKFRGMEADINFSLEDYEDIKQMGNLTKEEFVHVLRRQSTGFPRGSSKYRGVTLHKCGRWEARMGQFLGKKYVYLGLFDTEEEAARSYDRAAIKCNGKDAVTNFDPSTYAEEFELPAAASTGDDGEQNLDLSLGSSAGSNKRGSLDGGDDDGTAGSDQRVPMAFELDWQTAARSTKAKFDQNSTHHQMPPPVLQASHLPFSPRHSQVGTFAMPFSREFSRISSLFLFASNGDPGTAGGLSLTVGGASGGGGGHWLPHQYHHQQPPQQQQQRLHHGGWGNGAPGTSWPPPPQPHLPTAPPSNAAVAAAAAAASSRFPPYVATQAHSWLQKNGFHSLARPT

SEQ ID NO: 141 - DNA, 3765 bp, Artificial Sequence
  genetic construct
ggggacaagtttgtacaaaaaagcaggctgtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcatggtgtttgcggttttgtctcgctggggccgggtggcatggctcatcactggaggggtgatcctgctcgtcaccaatggggtcaattcgcgcattctggtcttcagcgaggatatattcttcatctacttgctcccgcccatcatctttaacgctgggtttcaagtaaagaaaaagcaattcttccgcaattttgcaacaattactttgtttggggctattgggacattgatatcctttgtaataatcagccttggtgccatgggattgttcagcaaacttgatgttgatccactccagcttggggactatcttgcaattggtgctatcttctcagcaacagattctgtttgcaccttacaggtgcttaaccaggatgaaacacccctactctatagtctggtttttggtgaaggtgttgttaatgatgctacatctgttgtgctattcaatgcaattcaaaacattgatcttgatcatttcgatgcgtttgttctactacaacttattggaaaattcctctacctacttttcaccagtactgttcttggaatagctaaaggtatggatagtgtatcttcatactgcatttgtttaatttgaaaatggttatctagttgcctaacaaaatatagctgggatatcttataacacatgtgcaggtgacatggaaaaaaatgcctatttttctatgcactaactattcatcatgtgacatacttccccaaaaaactaaataagccaaattttccagcttccgagtcctgaaaaagagtagtgtacctgatacaatttatagagttttttttttcgaaaagaagggatagccctcatagatagagtactaactaaaagtctacttttaccaatttcaggtttttgagctattccaagaacagtactggtgaaaagtaggtagaggaattttccaataagttgtagtagaacaaacgcatcgaaatgatcaagatcaatgttttgaattgcattgaatagcacaacagatgtagcatcattaacaacaccttcaccaaaaaccagactatagagtaggggtgtttcatcctggttaagcacctgtaaggtgcaaacagaatctgttgctgagaagatagcaccaattgcaagatagtccccaagctggagtggatcaacatcaagtttgctgaacaatcccatggcaccaaggctgattattacaaaggatatcaatgtcccaatagccccaaacaaagtaattgttgcaaaattgcggaagaattgctttttctttacttgaaacccagcgttaaagatgatgggcgggagcaagtagatgaagaatatatcctcgctgaagaccagaatgcgcgaattgaccccattggtgacgagcaggatcacccctccagtgatgagccatgccacccggccccagcgagacaaaaccgcaaacaccatgaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgaacccagctttcttgtacaaagtggtcccc

SEQ ID NO: 142 - DNA, 3627 bp, Artificial Sequence
  genetic construct
ggggacaagtttgtacaaaaaagcaggctgtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagggcgattgtgagggtgccggtgagatgttccaagtcacctccttgttcagccaggctgaaaaggttgacaaggagcttaaggagaaccctgcaccatctgaagctgatgttgaggctgctaagcttgttgtcaagggaaaaggagatgcagttgcgcaacttaaagcagcaaaagctagcaagcaagagataactgctgctgtttcggagcttacaaaggcaaaagaggttgtcttaaggctggaagagaggtctaagttgaaacctggaattccccacaaagatgatgggtccattgcgtttgagaatgacttcttcaagcgtgcagcctttctgactgtttcaggccaacttcaggttgagacttatgcttgtgctctcagcagtgtctatacctttggacccacattccgggcagagaactcacatacgtcaagacatttggcagaattttggatggttgaaccagaaattgcatatgcaaacttgcataaaggtatggatagtgtatcttcatactgcatttgtttaatttgaaaatggttatctagttgcctaacaaaatatagctgggatatcttataacacatgtgcaggtgacatggaaaaaaatgcctatttttctatgcactaactattcatcatgtgacatacttccccaaaaaactaaataagccaaattttccagcttccgagtcctgaaaaagagtagtgtacctgatacaatttatagagttttttttttcgaaaagaagggatagccctcatagatagagtactaactaaaagtctacttttaccaatttcaggtttttgatgcaagtttgcatatgcaatttctggttcaaccatccaaaattctgccaaatgtcttgacgtatgtgagttctctgcccggaatgtgggtccaaaggtatagacactgctgagagcacaagcataagtctcaacctgaagttggcctgaaacagtcagaaaggctgcacgcttgaagaagtcattctcaaacgcaatggacccatcatctttgtggggaattccaggtttcaacttagacctctcttccagccttaagacaacctcttttgcctttgtaagctccgaaacagcagcagttatctcttgcttgctagcttttgctgctttaagttgcgcaactgcatctccttttcccttgacaacaagcttagcagcctcaacatcagcttcagatggtgcagggttctccttaagctccttgtcaaccttttcagcctggctgaacaaggaggtgacttggaacatctcaccggcaccctcacaatcgcagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgaacccagctttcttgtacaaagtggtcccc

SEQ ID NO: 143 - DNA, 3601 bp, Artificial Sequence
  genetic construct
ggggacaagtttgtacaaaaaagcaggctgtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtctcgggaaacacgcattggcaataccggccgatcgatcgacagatcggcacggggtccggcgaggcgcgatggcgtatcgggtgctggaggtgacgctgatctcggccaaggacctgaagaaggtgacggtgttctccaagatgcgggtgtacgcggtggcgtccatctccggcggcgacccgcgcacgccgacgcaccggacgcactcggaccggcacggcgggccgctgcggttcccaataccgatcgccgccgacccccgcgggctcgcactgcacgtgctcctccgctccgagcgctccttcggcgaccgcgacgtcggcgaggtgctcgtccccgtccaggaccttttcgccgcagcgcctctcgccggcgagcatcgccacctcagctaccaggtgcgacgccccatgagcggccggaagcgcggggtgctccacatctcctacagcctcacggacgcgccggcgatagggaaaggtatggatagtgtatcttcatactgcatttgtttaatttgaaaatggttatctagttgcctaacaaaatatagctgggatatcttataacacatgtgcaggtgacatggaaaaaaatgcctatttttctatgcactaactattcatcatgtgacatacttccccaaaaaactaaataagccaaattttccagcttccgagtcctgaaaaagagtagtgtacctgatacaatttatagagttttttttttcgaaaagaagggatagccctcatagatagagtactaactaaaagtctacttttaccaatttcaggtttttgccctatcgccggcgcgtccgtgaggctgtaggagatgtggagcaccccgcgcttccggccgctcatggggcgtcgcacctggtagctgaggtggcgatgctcgccggcgagaggcgctgcggcgaaaaggtcctggacggggacgagcacctcgccgacgtcgcggtcgccgaaggagcgctcggagcggaggagcacgtgcagtgcgagcccgcgggggtcggcggcgatcggtattgggaaccgcagcggcccgccgtgccggtccgagtgcgtccggtgcgtcggcgtgcgcgggtcgccgccggagatggacgccaccgcgtacacccgcatcttggagaacaccgtcaccttcttcaggtccttggccgagatcagcgtcacctccagcacccgatacgccatcgcgcctcgccggaccccgtgccgatctgtcgatcgatcggccggtattgccaatgcgtgtttcccgagaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgaacccagctttcttgtacaaagtggtcccc

SEQ ID NO: 144 - DNA, 4013 bp, Artificial Sequence
  genetic construct
ggggacaagtttgtacaaaaaagcaggctgtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggatgcgcgtcaccatcaccggcggcgggacgaggctgcacgtggacctctactacgcgtgcgtgcagagccgcgcgctcttcacggtgtggagcctcctgcagctgatgcggcggcaccgcggccgcgtccccgacgtggacctcatgttcgactgcatggaccggcccgccatcaaccgcaccgagcacagcggcgagggcgcgccccctccgccgccgctgttccggtactgcaccactcgcgaccacttcgacatcccgttcccggactggtccttctggggctggccggagacgcacctcgagccctggagccgcgagttcaagagcatccggcagggcgccaagaagaactgggacgaggaggcgaggtccgggtaccagaactcgaagctgtcgagccagtgcacgcaccggtacaagatctacgcggaggggttcgcgtggtcggtgagcctgaaatacatcctctcctgcggctccacggcgctcctgatcgacccgctgtaccaggacttcttcagccgggggctggagccgcgggtgaaccacctgccggtgagcaccgtggggatgtgcgagtccatcagggacgccgtggagtggggcaacgcgcacccggacgaggcggagcgcgtcgggcggcgcgggcagcggctgatgcaggacctggccatggacgccaaaggtatggatagtgtatcttcatactgcatttgtttaatttgaaaatggttatctagttgcctaacaaaatatagctgggatatcttataacacatgtgcaggtgacatggaaaaaaatgcctatttttctatgcactaactattcatcatgtgacatacttccccaaaaaactaaataagccaaattttccagcttccgagtcctgaaaaagagtagtgtacctgatacaatttatagagttttttttttcgaaaagaagggatagccctcatagatagagtactaactaaaagtctacttttaccaatttcaggtttttgggcgtccatggccaggtcctgcatcagccgctgcccgcgccgcccgacgcgctccgcctcgtccgggtgcgcgttgccccactccacggcgtccctgatggactcgcacatccccacggtgctcaccggcaggtggttcacccgcggctccagcccccggctgaagaagtcctggtacagcgggtcgatcaggagcgccgtggagccgcaggagaggatgtatttcaggctcaccgaccacgcgaacccctccgcgtagatcttgtaccggtgcgtgcactggctcgacagcttcgagttctggtacccggacctcgcctcctcgtcccagttcttcttggcgccctgccggatgctcttgaactcgcggctccagggctcgaggtgcgtctccggccagccccagaaggaccagtccgggaacgggatgtcgaagtggtcgcgagtggtgcagtaccggaacagcggcggcggagggggcgcgccctcgccgctgtgctcggtgcggttgatggcgggccggtccatgcagtcgaacatgaggtccacgtcggggacgcggccgcggtgccgccgcatcagctgcaggaggctccacaccgtgaagagcgcgcggctctgcacgcacgcgtagtagaggtccacgtgcagcctcgtcccgccgccggtgatggtgacgcgcatagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgaacccagctttcttgtacaaagtggtcccc

SEQ ID NO: 145 - DNA, 3615 bp, Artificial Sequence
  genetic construct
ggggacaagtttgtacaaaaaagcaggctgtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggggagaaggaacattctggatgttatgcattgcttcgggatgacaaggtggatgatcttaaaaggatgttttcgctcttctcaaaaatcacccgtggtctggaacctgtttctaacatgttcaaatcgcatgttacgaatgagggtacagctttggtcaagcaagcagaagattctgctagtaataaaaagccagagaagaaggagatggttggaatgcaggaacaggtttttgtctggaaaatcattgcactgcatgataagtatgtagcatatgtgacagattgtttccacggccatacactcttccacaaggcacttaaagaagcctttgaggtcttctgcaataagggtgtctctggcagttcgagtgctgaattgctcgccaccttctgtgacaacattctgaagaaaggctgcagtgaaaagctcagtgatgaagccattgaagatgcccttgagaaggtggtgcgcctgcttgcatacataagtgataaagaccaaaggtatggatagtgtatcttcatactgcatttgtttaatttgaaaatggttatctagttgcctaacaaaatatagctgggatatcttataacacatgtgcaggtgacatggaaaaaaatgcctatttttctatgcactaactattcatcatgtgacatacttccccaaaaaactaaataagccaaattttccagcttccgagtcctgaaaaagagtagtgtacctgatacaatttatagagttttttttttgtactaactaaaagtctacttttaccaatttcaggtttttgggtctttatcacttatgtatgcaagcaggcgcaccaccttctcaagggcatcttcaatggcttcatcactgagcttttcactgcagcctttcttcagaatgttgtcacagaaggtggcgagcaattcagcactcgaactgccagagacacccttattgcagaagacctcaaaggcttctttaagtgccttgtggaagagtgtatggccgtggaaacaatctgtcacatatgctacatacttatcatgcagtgcaatgattttccagacaaaaacctgttcctgcattccaaccatctccttcttctctggctttttattactagcagaatcttctgcttgcttgaccaaagctgtaccctcattcgtaacatgcgatttgaacatgttagaaacaggttccagaccacgggtgatttttgagaagagcgaaaacatccttttaagatcatccaccttgtcatcccgaagcaatgcataacatccagaatgttccttctccagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgaacccagctttcttgtacaaagtggtcccc

SEQ ID NO: 146 - DNA, 3845 bp, Artificial Sequence
  genetic construct
ggggacaagtttgtacaaaaaagcaggctgtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtgcctcgagtaggtgaggtagcatcttcatcttctccatccgatcatgacaatgaggagcaggaacaggtcacagttgtccgcactcttgaaagcttgaaccagaaaaatgaaggcaaggcaccacatcaaaaggaaaagcagcaacgcaataaccgcccgcaacctcggagatcttatcctaaaccaagtgcgtcattttacggatcacgcttacaaaatcagacatacccaaatgttgcacaagagcaagcaatgtaccatatgtggcaccaggtgcaaccaacacagcagaagccccattttcggatggttccaactatgggcaacacaaggtttccaccgccaccaactatactctccatgtaccctccacctagaggacagttcgccgtgccagccagccaagatgctttggctctaattccatgttttcctgaagctgctcctgcccttccacggtacttctcgccttaccctgcctcatacgtaccagcaagtccactgccagctgcagttaacatgatgcatgggagaaggcaagggtgtgctgaaacggttgagcttcctgatgcaccagttttcgccagatacactgctcaaaggtatggatagtgtatcttcatactgcatttgtttaatttgaaaatggttatctagttgcctaacaaaatatagctgggatatcttataacacatgtgcaggtgacatggaaaaaaatgcctatttttctatgcactaactattcatcatgtgacatacttccccaaaaaactaaataagccaaattttccagcttccgagtcctgaaaaagagtagtgtacctgatacaatttatagagttttttttttcgaaaagaagggatagccctcatagatagagtactaactaaaagtctacttttaccaatttcaggtttttggagcagtgtatctggcgaaaactggtgcatcaggaagctcaaccgtttcagcacacccttgccttctcccatgcatcatgttaactgcagctggcagtggacttgctggtacgtatgaggcagggtaaggcgagaagtaccgtggaagggcaggagcagcttcaggaaaacatggaattagagccaaagcatcttggctggctggcacggcgaactgtcctctaggtggagggtacatggagagtatagttggtggcggtggaaaccttgtgttgcccatagttggaaccatccgaaaatggggcttctgctgtgttggttgcacctggtgccacatatggtacattgcttgctcttgtgcaacatttgggtatgtctgattttgtaagcgtgatccgtaaaatgacgcacttggtttaggataagatctccgaggttgcgggcggttattgcgttgctgcttttccttttgatgtggtgccttgccttcatttttctggttcaagctttcaagagtgcggacaactgtgacctgttcctgctcctcattgtcatgatcggatggagaagatgaagatgctacctcacctactcgaggcaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgaacccagctttcttgtacaaagtggtcccc

SEQ ID NO: 147 - DNA, 3645 bp, Artificial Sequence
  genetic construct
ggggacaagtttgtacaaaaaagcaggctgtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtttcactgtacttgagaggctagtaagcagatgccgcaacctcaagactctgaagctcaacaatgcaatccctcttgacaatgttgctagcctgcttcgtaaggctccgcaaataatagaactcggaactggcaaattctctgctgactatcatccagatctttttgcaaaggttgaagcagcatttgcaggttgtacaagcctaagaaggctttctgggacttgggacgctgttccagattacctgccagcattctattgtgtatgtgaaggcctcacatctcttaatctgagttatgccaccgtgcaaggccctgagctcatcaaattcattagcagatgcaagaatctgctgcagttatgggtgatggacctcattgaggaccatggtctatctgttgtggcatcaagttgcagtaaactgcaagagttgcgggtcttcccttccgatccttttggtcataacggcgggcaagttttcttgacagaaagaggtcttgaaaggtatggatagtgtatcttcatactgcatttgtttaatttgaaaatggttatctagttgcctaacaaaatatagctgggatatcttataacacatgtgcaggtgacatggaaaaaaatgcctatttttctatgcactaactattcatcatgtgacatacttccccaaaaaactaaataagccaaattttccagcttccgagtcctgaaaaagagtagtgtacctgatacaatttatagagttttttttttcgaaaagaagggatagccctcatagatagagtactaactaaaagtctacttttaccaatttcaggtttttgcaagacctctttctgtcaagaaaacttgcccgccgttatgaccaaaaggatcggaagggaagacccgcaactcttgcagtttactgcaacttgatgccacaacagatagaccatggtcctcaatgaggtccatcacccataactgcagcagattcttgcatctgctaatgaatttgatgagctcagggccttgcacggtggcataactcagattaagagatgtgaggccttcacatacacaatagaatgctggcaggtaatctggaacagcgtcccaagtcccagaaagccttcttaggcttgtacaacctgcaaatgctgcttcaacctttgcaaaaagatctggatgatagtcagcagagaatttgccagttccgagttctattatttgcggagccttacgaagcaggctagcaacattgtcaagagggattgcattgttgagcttcagagtcttgaggttgcggcatctgcttactagcctctcaagtacagtgaaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgaacccagctttcttgtacaaagtggtcccc

SEQ ID NO: 148 - DNA, 3251 bp, Artificial Sequence
  genetic construct
ggggacaagtttgtacaaaaaagcaggctgtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggatggcgcagtccggcagcgacgccgcaccgatcagcacgcaccccaccgaggaggaggaggtgacggtggagaggacgccggaggaggaggcggccaggctcaggtacctcgagttcgtgcagcaggcggcggcgcaggcggtcgtgctggccgccgcggcctacgcctacgccaagcagggcgcggggccgctccgccccggcgtcgaccacgtcgagggcaccgtcaaggccgtcgtcggccctgtgtatgatcggtaccacgccgtgccgctcgacctcctcaagttcctcgaccgcaagaaaggtatggatagtgtatcttcatactgcatttgtttaatttgaaaatggttatctagttgcctaacaaaatatagctgggatatcttataacacatgtgcaggtgacatggaaaaaaatgcctatttttctatgcactaactattcatcatgtgacatacttccccaaaaaactaaataagccaaattttccagcttccgagtcctgaaaaagagtagtgtacctgatacaatttatagagttttttttttcgaaaagaagggatagccctcatagatagagtactaactaaaagtctacttttaccaatttcaggtttttgcttgcggtcgaggaacttgaggaggtcgagcggcacggcgtggtaccgatcatacacagggccgacgacggccttgacggtgccctcgacgtggtcgacgccggggcggagcggccccgcgccctgcttggcgtaggcgtaggccgcggcggccagcacgaccgcctgcgccgccgcctgctgcacgaactcgaggtacctgagcctggccgcctcctcctccggcgtcctctccaccgtcacctcctcctcctcggtggggtgcgtgctgatcggtgcggcgtcgctgccggactgcgccatagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgaacccagctttcttgtacaaagtggtcccc

SEQ ID NO: 149 - DNA, 3365 bp, Artificial Sequence
  genetic construct
ggggacaagtttgtacaaaaaagcaggctgtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtctccatgggttattctaaatcggcggtttatagagtattgtattcttggctgggagaatcttcctcgggttcttctcatgtacttcaacaacgtagtgctgcctcaggaaggatacttccactcagtcatatgcaactcggttgatttccgtaattccactgtgaacaatgatttgaggtacaaggtgtgggatgaaccacctcagacagagcccctatttctgaacatggcacattatgatgagatggtgaacagcggacagccttttgcaaggcgttttcagaagaaggaaccattgctggacaagatcgatgacaaactactcaggcgtcctgggcatgggcctgttcctggtgccaaaggtatggatagtgtatcttcatactgcatttgtttaatttgaaaatggttatctagttgcctaacaaaatatagctgggatatcttataacacatgtgcaggtgacatggaaaaaaatgcctatttttctatgcactaactattcatcatgtgacatacttccccaaaaaactaaataagccaaattttccagcttccgagtcctgaaaaagagtagtgtacctgatacaatttatagagttttttttttcgaaaagaagggatagccctcatagatagagtactaactaaaagtctacttttaccaatttcaggtttttgggcaccaggaacaggcccatgcccaggacgcctgagtagtttgtcatcgatcttgtccagcaatggttccttcttctgaaaacgccttgcaaaaggctgtccgctgttcaccatctcatcataatgtgccatgttcagaaataggggctctgtctgaggtggttcatcccacaccttgtacctcaaatcattgttcacagtggaattacggaaatcaaccgagttgcatatgactgagtggaagtatccttcctgaggcagcactacgttgttgaagtacatgagaagaacccgaggaagattctcccagccaagaatacaatactctataaaccgccgatttagaataacccatggagaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgaacccagctttcttgtacaaagtggtcccc

SEQ ID NO: 150 - DNA, 3613 bp, Artificial Sequence
  genetic construct
ggggacaagtttgtacaaaaaagcaggctgtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggcaatccagacatagccaccggtcatcatctggagctcgttagctatagaaaataatcgcagccctgtatcaggattgacatgcacaaccagaacccttgattccatcatgttaactttaaacagtatatcactgatcacatctttgttcgcatctggaggaattactgctttatatgaaattctggcacgctttgttgcaagggcatcaccaagggcagacaccccacctctcccataatcatcatcaacaaatatagcagttacctctttccattgatagtagtaagcaatgctagcaatcgcacgcatttggaagtaatcgctgacagtgctccttaaaaagtaagaatactccgatgcagaaagagttggatcagtggctgcgaatgataggagcggaacatgcagctcattaacaaaatgtgagatgacatggcctatcacagaggactgcgggccaacaactgcaaccacatttttctcaaaggtatggatagtgtatcttcatactgcatttgtttaatttgaaaatggttatctagttgcctaacaaaatatagctgggatatcttataacacatgtgcaggtgacatggaaaaaaatgcctatttttctatgcactaactattcatcatgtgacatacttccccaaaaaactaaataagccaaattttccagcttccgagtcctgaaaaagagtagtgtacctgatacaatttatagagttttttttttcgaaaagaagggatagccctcatagatagagtactaactaaaagtctacttttaccaatttcaggtttttggagaaaaatgtggttgcagttgttggcccgcagtcctctgtgataggccatgtcatctcacattttgttaatgagctgcatgttccgctcctatcattcgcagccactgatccaactctttctgcatcggagtattcttactttttaaggagcactgtcagcgattacttccaaatgcgtgcgattgctagcattgcttactactatcaatggaaagaggtaactgctatatttgttgatgatgattatgggagaggtggggtgtctgcccttggtgatgcccttgcaacaaagcgtgccagaatttcatataaagcagtaattcctccagatgcgaacaaagatgtgatcagtgatatactgtttaaagttaacatgatggaatcaagggttctggttgtgcatgtcaatcctgatacagggctgcgattattttctatagctaacgagctccagatgatgaccggtggctatgtctggattgagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgaacccagctttcttgtacaaagtggtcccc

SEQ ID NO: 151 - DNA, 3445 bp, Artificial Sequence
  genetic construct
ggggacaagtttgtacaaaaaagcaggctgtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcatagtagaccggcttggcggcgcagccgtaggcggcgttggagcaaggcacccggatggactccagcagcttctccatgtcgtggttccggtggtatccgccggaagtcgccgtgcgacacacatggcacctccgagccgcccccagcttgtctcggcacgtcgagcacaccacgtgccccaccttacactgcaagcgcggagacatgagacgatgagcccttgttcgcatggttgacatcattttgcatatgttaattacctggaagatgggcggcttgagtggtaggcagcaaaggcggcagtcgagggcgtcggtgttgtctaaagtcacgccgtggagtgccgctgccgcgcgtgtagacgccggtgccattgtttctacttgactgtccaggaaaaggtatggatagtgtatcttcatactgcatttgtttaatttgaaaatggttatctagttgcctaacaaaatatagctgggatatcttataacacatgtgcaggtgacatggaaaaaaatgcctatttttctatgcactaactattcatcatgtgacatacttccccaaaaaactaaataagccaaattttccagcttccgagtcctgaaaaagagtagtgtacctgatacaatttatagagttttttttttcgaaaagaagggatagccctcatagatagagtactaactaaaagtctacttttaccaatttcaggtttttgtcctggacagtcaagtagaaacaatggcaccggcgtctacacgcgcggcagcggcactccacggcgtgactttagacaacaccgacgccctcgactgccgcctttgctgcctaccactcaagccgcccatcttccaggtaattaacatatgcaaaatgatgtcaaccatgcgaacaagggctcatcgtctcatgtctccgcgcttgcagtgtaaggtggggcacgtggtgtgctcgacgtgccgagacaagctgggggcggctcggaggtgccatgtgtgtcgcacggcgacttccggcggataccaccggaaccacgacatggagaagctgctggagtccatccgggtgccttgctccaacgccgcctacggctgcgccgccaagccggtctactatgaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgaacccagctttcttgtacaaagtggtcccc

SEQ ID NO: 152 - DNA, 3717 bp, Artificial Sequence
  genetic construct
ggggacaagtttgtacaaaaaagcaggctgtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggatgggtatcatagtcaatatgccttctgaatatgttggaaaaagtgcaaaccggctgaaggagcatttctcacgtttttatcctgtgaaagtgcaccatgtgtacagtaaaggtcgccctacaggaaatgctattgttgagtttgggaaggacttggttggttttagaaatgcactaacatttgagaatcaatttgagaaggaagggcatgggaaaataggctggcaggaaaaacagcatggagggccagagccttttggatggatcgctagagcagacgattacaatgctccaggagcaataggggactttctaagaaaaaatggtgatctgaagacggctgacggtgttgaggatgaagaaacaatgaaaaataacaaacttgtggccagtttatcttttaaagttattgaaactgatatgcatataccagaacttaaatctgtgtatcaggagagaactgcctcactgaaaagaatgatggagcagagggaacagcagctacagtcatacaatcaagtgcgtcctaatcttctaaaggtatggatagtgtatcttcatactgcatttgtttaatttgaaaatggttatctagttgcctaacaaaatatagctgggatatcttataacacatgtgcaggtgacatggaaaaaaatgcctatttttctatgcactaactattcatcatgtgacatacttccccaaaaaactaaataagccaaattttccagcttccgagtcctgaaaaagagtagtgtacctgatacaatttatagagttttttttttcgaaaagaagggatagccctcatagatagagtactaactaaaagtctacttttaccaatttcaggtttttgagaagattaggacgcacttgattgtatgactgtagctgctgttccctctgctccatcattcttttcagtgaggcagttctctcctgatacacagatttaagttctggtatatgcatatcagtttcaataactttaaaagataaactggccacaagtttgttatttttcattgtttcttcatcctcaacaccgtcagccgtcttcagatcaccattttttcttagaaagtcccctattgctcctggagcattgtaatcgtctgctctagcgatccatccaaaaggctctggccctccatgctgtttttcctgccagcctattttcccatgcccttccttctcaaattgattctcaaatgttagtgcatttctaaaaccaaccaagtccttcccaaactcaacaatagcatttcctgtagggcgacctttactgtacacatggtgcactttcacaggataaaaacgtgagaaatgctccttcagccggtttgcactttttccaacatattcagaaggcatattgactatgatacccatagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgaacccagctttcttgtacaaagtggtcccc

SEQ ID NO: 153 - DNA, 3589 bp, Artificial Sequence
  genetic construct
ggggacaagtttgtacaaaaaagcaggctgtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagggtcgtgagcaaatcttcctttggcggcagcgctcctctgaagaatggtgaatttgagaagatgctggaaatggaaccgcagaaaaccgtggtcatagattttactgatgtggacatccctgtgctagaagaggcaaaaccgcttatttgtggaatcggtgagtttggtgatgatgttctgaaggagcaacagctttccaccaaggagattgcaatttacggattatatctttgccccatttggtttgtcacagagtatttatcaaatgcagcccttgcaagaacaagtgttgccagtactacggtactatcttcaacttcgggactcttcacactcttcattagtgtgctccttggccaagattccataaatgctgccaaagttattgctgtttttgttagcatggctggtgtagcaatgacaactatgggccagacttgggcaacagatgaatctgaagtaagcaattcagaaaggtatggatagtgtatcttcatactgcatttgtttaatttgaaaatggttatctagttgcctaacaaaatatagctgggatatcttataacacatgtgcaggtgacatggaaaaaaatgcctatttttctatgcactaactattcatcatgtgacatacttccccaaaaaactaaataagccaaattttccagcttccgagtcctgaaaaagagtagtgtacctgatacaatttatagagttttttttttcgaaaagaagggatagccctcatagatagagtactaactaaaagtctacttttaccaatttcaggtttttgctgaattgcttacttcagattcatctgttgcccaagtctggcccatagttgtcattgctacaccagccatgctaacaaaaacagcaataactttggcagcatttatggaatcttggccaaggagcacactaatgaagagtgtgaagagtcccgaagttgaagatagtaccgtagtactggcaacacttgttcttgcaagggctgcatttgataaatactctgtgacaaaccaaatggggcaaagatataatccgtaaattgcaatctccttggtggaaagctgttgctccttcagaacatcatcaccaaactcaccgattccacaaataagcggttttgcctcttctagcacagggatgtccacatcagtaaaatctatgaccacggttttctgcggttccatttccagcatcttctcaaattcaccattcttcagaggagcgctgccgccaaaggaagatttgctcacgacagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgaacccagctttcttgtacaaagtggtcccc

SEQ ID NO: 154 - DNA, 3645 bp, Artificial Sequence
  genetic construct
ggggacaagtttgtacaaaaaagcaggctgtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggcacactcttcattagtgtgctccttggccaagattccataaatgctgccaaagttattgctgtttttgttagcatggctggtgtagcaatgacaactatgggccagacttgggcaacagatgaatctgaagtaagcaattcaggaacttatcgccttgctaaccatctaattcttaagccttactactgcagggccacacagaggactcttctaggtgatatgtttggtcttctgtcagctgtgtcatatggtctcttcactgtgcttctcaaaaagtttgctggaggagaaggatctgaaaaggttgatgtccaaaaactgttcggctttctcggacttttcactctttgtcttctctggtggcttgtctggccattaactgcgctaggcattgagccaaagtttacaatgccccactcagctaaagtggatgaagttgttctggcaaatggccttattgggagtgtgctatcagactatttctgggctctatctgttgaaaggtatggatagtgtatcttcatactgcatttgtttaatttgaaaatggttatctagttgcctaacaaaatatagctgggatatcttataacacatgtgcaggtgacatggaaaaaaatgcctatttttctatgcactaactattcatcatgtgacatacttccccaaaaaactaaataagccaaattttccagcttccgagtcctgaaaaagagtagtgtacctgatacaatttatagagttttttttttcgaaaagaagggatagccctcatagatagagtactaactaaaagtctacttttaccaatttcaggtttttgcaacagatagagcccagaaatagtctgatagcacactcccaataaggccatttgccagaacaacttcatccactttagctgagtggggcattgtaaactttggctcaatgcctagcgcagttaatggccagacaagccaccagagaagacaaagagtgaaaagtccgagaaagccgaacagtttttggacatcaaccttttcagatccttctcctccagcaaactttttgagaagcacagtgaagagaccatatgacacagctgacagaagaccaaacatatcacctagaagagtcctctgtgtggccctgcagtagtaaggcttaagaattagatggttagcaaggcgataagttcctgaattgcttacttcagattcatctgttgcccaagtctggcccatagttgtcattgctacaccagccatgctaacaaaaacagcaataactttggcagcatttatggaatcttggccaaggagcacactaatgaagagtgtgagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgaacccagctttcttgtacaaagtggtcccc

SEQ ID NO: 155 - DNA, 3629 bp, Artificial Sequence
  genetic construct
ggggacaagtttgtacaaaaaagcaggctgtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggggagcgcacgccatacagccccgccaagttcctctataggtccggatctcaagctctatttgcattggttgatgcagcgctgtgatttcagcaacgtgctgtttttttttcaatgctgggttcgttgcgtattagggaagttagccgttagttaaatggctgtgtcaagtattgtaactgtgggaagcaggtcttgtttgagacagtatactgtatattctctcctgcaaaagatagagtaatctttctatgctattccatggaactaagttagatcatgcagattgcaagtctacttaacatgatatggaatgatgtgaacagagatatatcactaaaaggggcaaggtttgcttagtgggagctgctactggggggaaatggttgcacgtttgcatttctatggcctgtttgaggaaatcccctcgtatataaagcatgtatagagttaagttcttatgttttcatttgattctgcaagtactcttggcaaaaggtatggatagtgtatcttcatactgcatttgtttaatttgaaaatggttatctagttgcctaacaaaatatagctgggatatcttataacacatgtgcaggtgacatggaaaaaaatgcctatttttctatgcactaactattcatcatgtgacatacttccccaaaaaactaaataagccaaattttccagcttccgagtcctgaaaaagagtagtgtacctgatacaatttatagagttttttttttcgaaaagaagggatagccctcatagatagagtactaactaaaagtctacttttaccaatttcaggtttttgtgccaagagtacttgcagaatcaaatgaaaacataagaacttaactctatacatgctttatatacgaggggatttcctcaaacaggccatagaaatgcaaacgtgcaaccatttccccccagtagcagctcccactaagcaaaccttgccccttttagtgatatatctctgttcacatcattccatatcatgttaagtagacttgcaatctgcatgatctaacttagttccatggaatagcatagaaagattactctatcttttgcaggagagaatatacagtatactgtctcaaacaagacctgcttcccacagttacaatacttgacacagccatttaactaacggctaacttccctaatacgcaacgaacccagcattgaaaaaaaaacagcacgttgctgaaatcacagcgctgcatcaaccaatgcaaatagagcttgagatccggacctatagaggaacttggcggggctgtatggcgtgcgctccagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgaacccagctttcttgtacaaagtggtcccc

SEQ ID NO: 156 - DNA, 4445 bp, Artificial Sequence
  genetic construct
ggggacaagtttgtacaaaaaagcaggctgtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggatgggcaggcgaggcggcgtgttgtttgtggtggggggaggagacggcgtggcgaggaggcgggatggggaggcggcgccgcgaggaggaggggatgggggcgccggggacggatgcgtgctggggagggggagcgatgggtttctgcgagaggagaatagtggaggcgggatcgctaattacatggtggtagactactacctgtatgactacgagtacgccgagccgccgcgcgtgaccagcctgcagaacgccgttccccagaggaccttcagcgacttcggagatgacgtctacttcgtcgccgacaaacggggctacgagtccgtcgtccactacctcgccggccagtacctcaacaccgacgactccggcaacgtcgccgacccccgcctgcagctcaacaaggtggtgcgagagatctcctactcctcgagcggagtcaccgtcaagacggaggacggctcagtgtaccaggcagactatcgtcatgcatggaaaatcatcgccatctaccggttcgacatggcagtgtacaccaagatcttcctcaagttccctcggaagttctggcccacgggcgaaggcaagcagttcttcgtctacgccagctccaggcgaggctactacgggatgtggcagtccttcgaggaggagtacccgggggccaacgtgctcctcgtgacggtgacggaccaggagtcgcggcggatcgagcagcagccggacaacaccaccatggcggaggctgtggcggtgctgcggaggatgttccccgacgaggacgtccccgacgccaccgatatctacgtgcccaggtggtggtccaaccgcttcttcaagggctcctactccaactggcccatcggcgtcaaccgctacgaatacgaccagcttcggaaaggtatggatagtgtatcttcatactgcatttgtttaatttgaaaatggttatctagttgcctaacaaaatatagctgggatatcttataacacatgtgcaggtgacatggaaaaaaatgcctatttttctatgcactaactattcatcatgtgacatacttccccaaaaaactaaataagccaaattttccagcttccgagtcctgaaaaagagtagtgtacctgatacaatttatagagttttttttttcgaaaagaagggatagccctcatagatagagtactaactaaaagtctacttttaccaatttcaggtttttgccgaagctggtcgtattcgtagcggttgacgccgatgggccagttggagtaggagcccttgaagaagcggttggaccaccacctgggcacgtagatatcggtggcgtcggggacgtcctcgtcggggaacatcctccgcagcaccgccacagcctccgccatggtggtgttgtccggctgctgctcgatccgccgcgactcctggtccgtcaccgtcacgaggagcacgttggcccccgggtactcctcctcgaaggactgccacatcccgtagtagcctcgcctggagctggcgtagacgaagaactgcttgccttcgcccgtgggccagaacttccgagggaacttgaggaagatcttggtgtacactgccatgtcgaaccggtagatggcgatgattttccatgcatgacgatagtctgcctggtacactgagccgtcctccgtcttgacggtgactccgctcgaggagtaggagatctctcgcaccaccttgttgagctgcaggcgggggtcggcgacgttgccggagtcgtcggtgttgaggtactggccggcgaggtagtggacgacggactcgtagccccgtttgtcggcgacgaagtagacgtcatctccgaagtcgctgaaggtcctctggggaacggcgttctgcaggctggtcacgcgcggcggctcggcgtactcgtagtcatacaggtagtagtctaccaccatgtaattagcgatcccgcctccactattctcctctcgcagaaacccatcgctccccctccccagcacgcatccgtccccggcgcccccatcccctcctcctcgcggcgccgcctccccatcccgcctcctcgccacgccgtctcctccccccaccacaaacaacacgccgcctcgcctgcccatagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgaacccagctttcttgtacaaagtggtcccc

SEQ ID NO: 157 - DNA, 3645 bp, Artificial Sequence
  genetic construct
ggggacaagtttgtacaaaaaagcaggctgtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggccaatggcatcgatttcatccatgaaaataatacatggttgatgctcacgtgcatagttgaacatttctcttataagacgggcactttcaccaatatatttgtcaatgatagcacttgaaacaatctttaaaaagtttgcatcgatgttgctagcaatagctctagcaagcaatgtcttccccgttccaggtgggccatagagcagaacaccctttggcggtttgattccaacacggagaaacagttcaggattcataagcggtaactcgatggactcccgcagttcccttatttgatctgataatccacctacagctgagtaactgacgttgcctgggtcttcatgtagcatgttatagaccaccggatcaacctcacgcggtagagttctcataatggttaaagttgtcatgtcaagaacaacccgcgttccagctgtcagcttttctttgtcaactttactcctgcagccaaccacataacgtggcccactactggcaaaggtatggatagtgtatcttcatactgcatttgtttaatttgaaaatggttatctagttgcctaacaaaatatagctgggatatcttataacacatgtgcaggtgacatggaaaaaaatgcctatttttctatgcactaactattcatcatgtgacatacttccccaaaaaactaaataagccaaattttccagcttccgagtcctgaaaaagagtagtgtacctgatacaatttatagagttttttttttcgaaaagaagggatagccctcatagatagagtactaactaaaagtctacttttaccaatttcaggtttttggccagtagtgggccacgttatgtggttggctgcaggagtaaagttgacaaagaaaagctgacagctggaacgcgggttgttcttgacatgacaactttaaccattatgagaactctaccgcgtgaggttgatccggtggtctataacatgctacatgaagacccaggcaacgtcagttactcagctgtaggtggattatcagatcaaataagggaactgcgggagtccatcgagttaccgcttatgaatcctgaactgtttctccgtgttggaatcaaaccgccaaagggtgttctgctctatggcccacctggaacggggaagacattgcttgctagagctattgctagcaacatcgatgcaaactttttaaagattgtttcaagtgctatcattgacaaatatattggtgaaagtgcccgtcttataagagaaatgttcaactatgcacgtgagcatcaaccatgtattattttcatggatgaaatcgatgccattggagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgaacccagctttcttgtacaaagtggtcccc

SEQ ID NO: 158 - DNA, 3445 bp, Artificial Sequence
  genetic construct
ggggacaagtttgtacaaaaaagcaggctgtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagggccaactggcccacaacctcaggcccagcatacacacagcgacgtaggcctccaaggcggactgagggcaagatgcacggctcactgtgacagacaccagcctagacgagaagaacagccaaggcgtcctcgcggcaggcccaagcacgcaactcccgaactcgaattggtcaaaaccgaaaaccctagcctgcaaccctcctaaataatcacggaaaaccagatcttctcgtccagtagccagcaaccctagccaggacccgcggatagctcggagcgagtcaactagcctgaaccctgtgcggaccctcgtctccagctcgcggcagttgaggagcttgttgcggtagtcggtgaccacggtgcggcggcgggcggccgcggcatcgtcggcctcggcaaaggtatggatagtgtatcttcatactgcatttgtttaatttgaaaatggttatctagttgcctaacaaaatatagctgggatatcttataacacatgtgcaggtgacatggaaaaaaatgcctatttttctatgcactaactattcatcatgtgacatacttccccaaaaaactaaataagccaaattttccagcttccgagtcctgaaaaagagtagtgtacctgatacaatttatagagttttttttttcgaaaagaagggatagccctcatagatagagtactaactaaaagtctacttttaccaatttcaggtttttggccgaggccgacgatgccgcggccgcccgccgccgcaccgtggtcaccgactaccgcaacaagctcctcaactgccgcgagctggagacgagggtccgcacagggttcaggctagttgactcgctccgagctatccgcgggtcctggctagggttgctggctactggacgagaagatctggttttccgtgattatttaggagggttgcaggctagggttttcggttttgaccaattcgagttcgggagttgcgtgcttgggcctgccgcgaggacgccttggctgttcttctcgtctaggctggtgtctgtcacagtgagccgtgcatcttgccctcagtccgccttggaggcctacgtcgctgtgtgtatgctgggcctgaggttgtgggccagttggcagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgaacccagctttcttgtacaaagtggtcccc

SEQ ID NO: 159 - DNA, 3801 bp, Artificial Sequence
  genetic construct
ggggacaagtttgtacaaaaaagcaggctgtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggcctttcctctattccttttactgtcttggaccatatatcctggctcttcatgagtttttcattcatttctgcaactttctttttctccaacatagtattttcaagcttaagttgcatctcttgaagcttatcatttacagctttatccacagcaacagaaatgtgttccctatctttcttagcgtctgacagaaagcctcgtaatactctctctgagtttcaagttggcttgcaagaagacggttgtactcatccacgattgtatcagttttgctgctaaacataactccacccatatccgagtcatcgttgtccccagaaaattcacactttgacctgagcttagaatgttttgcatcgcttttcgagtgattaagacgatgaacataactgtcaccgacataatcccaaacacgttgagtttccaaatcaagagaatagcagtgctgagtgtctttccagtgcctaattgagtggccttctttataccttccgcatccaacaaaaccacatatcacacagatccagaggttttcagaggtctgacaaacagaacatgtaggatttgtaggagtttcaaaggtatggatagtgtatcttcatactgcatttgtttaatttgaaaatggttatctagttgcctaacaaaatatagctgggatatcttataacacatgtgcaggtgacatggaaaaaaatgcctatttttctatgcactaactattcatcatgtgacatacttccccaaaaaactaaataagccaaattttccagcttccgagtcctgaaaaagagtagtgtacctgatacaatttatagagttttttttttcgaaaagaagggatagccctcatagatagagtactaactaaaagtctacttttaccaatttcaggtttttggaaactcctacaaatcctacatgttctgtttgtcagacctctgaaaacctctggatctgtgtgatatgtggttttgttggatgcggaaggtataaagaaggccactcaattaggcactggaaagacactcagcactgctattctcttgatttggaaactcaacgtgtttgggattatgtcggtgacagttatgttcatcgtcttaatcactcgaaaagcgatgcaaaacattctaagctcaggtcaaagtgtgaattttctggggacaacgatgactcggatatgggtggagttatgtttagcagcaaaactgatacaatcgtggatgagtacaaccgtcttcttgcaagccaacttgaaactcagagagagtattacgaggctttctgtcagacgctaagaaagatagggaacacatttctgttgctgtggataaagctgtaaatgataagcttcaagagatgcaacttaagcttgaaaatactatgttggagaaaaagaaagttgcagaaatgaatgaaaaactcatgaagagccaggatatatggtccaagacagtaaaaggaatagaggaaaggagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgaacccagctttcttgtacaaagtggtcccc

SEQ ID NO: 160 - DNA, 3645 bp, Artificial Sequence
  genetic construct
ggggacaagtttgtacaaaaaagcaggctgtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcagcctggccgtcttcctcaccatcgtcgtcctcctcctggccgacctcttctgctcccacctccgcctccgccgcctccgcgctgacgccgagatggcgccgcacaagaggccgaagcttggcgtcccggcgtcgtccccgccgcacaccgccgacgacgcgtcggtggccaccaccaccaccacggcgacgcacgaggcgctctccagcaccccgcccttctactacgcgcacggcgtcatgtgcgcgcccacccgcaaggacctcctcctcgccatccccaagctggaggccgccgtgtggaagtggtctcccgcgcgccgctcctcgccgtcgccttcgccgccgcggtccgagcccaccgcccgcgagtcctcctcctccgcgtacagcgacggcttcctgcgcatctccaaccccgtgtacgagcggggcgccacggccgcgccgggcgggtacgaagaagacacgccgttcgacacgcctgacgcatcgccgaaaggtatggatagtgtatcttcatactgcatttgtttaatttgaaaatggttatctagttgcctaacaaaatatagctgggatatcttataacacatgtgcaggtgacatggaaaaaaatgcctatttttctatgcactaactattcatcatgtgacatacttccccaaaaaactaaataagccaaattttccagcttccgagtcctgaaaaagagtagtgtacctgatacaatttatagagttttttttttcgaaaagaagggatagccctcatagatagagtactaactaaaagtctacttttaccaatttcaggtttttgcggcgatgcgtcaggcgtgtcgaacggcgtgtcttcttcgtacccgcccggcgcggccgtggcgccccgctcgtacacggggttggagatgcgcaggaagccgtcgctgtacgcggaggaggaggactcgcgggcggtgggctcggaccgcggcggcgaaggcgacggcgaggagcggcgcgcgggagaccacttccacacggcggcctccagcttggggatggcgaggaggaggtccttgcgggtgggcgcgcacatgacgccgtgcgcgtagtagaagggcggggtgctggagagcgcctcgtgcgtcgccgtggtggtggtggtggccaccgacgcgtcgtcggcggtgtgcggcggggacgacgccgggacgccaagcttcggcctcttgtgcggcgccatctcggcgtcagcgcggaggcggcggaggcggaggtgggagcagaagaggtcggccaggaggaggacgacgatggtgaggaagacggccaggctgaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgaacccagctttcttgtacaaagtggtcccc

SEQ ID NO: 161 - DNA, 3905 bp, Artificial Sequence
  genetic construct
ggggacaagtttgtacaaaaaagcaggctgtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggatggcgcctcttgccgccgcggccgcggcggtggcggcgaaggaggagctgggcgtgacggtggccgtggcgccgccgatggcgctggccccgctgagccagcagcagccgcggcggcagtaccgcggcgtgcgcatgcggaagtggggcaagtgggtggcggagatccgggagccgcacaagcgcacgcgcatctggctcggctcctacgccacgcccgtcgccgccgcgcgcgcctacgacacggccgtcttctacctgcgcggccggtcggccaggctcaacttccccgacgagatctccgcgctggcgccgctgtccccgccgcccgaggagctggaggccgacggcggcgcgctgtcggcggcgtcgatccggaagaaggccatcgaggtcgggtcccgcgtcgacgcgctccagaccgggatgaccatggtcgccaccgccgccgcgccggcgacaaaccaccgggagcggcagaggcagcaccacgcgcagcagcaggctgcgcgcgacgaggagctgctccagctccaccaccagaagcagcagcggacggcgtggaacgggcgggccaagaacccggatctcaaccaggcgcccgaccccgacagctccgacgccgagtgaaaaggtatggatagtgtatcttcatactgcatttgtttaatttgaaaatggttatctagttgcctaacaaaatatagctgggatatcttataacacatgtgcaggtgacatggaaaaaaatgcctatttttctatgcactaactattcatcatgtgacatacttccccaaaaaactaaataagccaaattttccagcttccgagtcctgaaaaagagtagtgtacctgatacaatttatagagttttttttttcgaaaagaagggatagccctcatagatagagtactaactaaaagtctacttttaccaatttcaggtttttgtcactcggcgtcggagctgtcggggtcgggcgcctggttgagatccgggttcttggcccgcccgttccacgccgtccgctgctgcttctggtggtggagctggagcagctcctcgtcgcgcgcagcctgctgctgcgcgtggtgctgcctctgccgctcccggtggtttgtcgccggcgcggcggcggtggcgaccatggtcatcccggtctggagcgcgtcgacgcgggacccgacctcgatggccttcttccggatcgacgccgccgacagcgcgccgccgtcggcctccagctcctcgggcggcggggacagcggcgccagcgcggagatctcgtcggggaagttgagcctggccgaccggccgcgcaggtagaagacggccgtgtcgtaggcgcgcgcggcggcgacgggcgtggcgtaggagccgagccagatgcgcgtgcgcttgtgcggctcccggatctccgccacccacttgccccacttccgcatgcgcacgccgcggtactgccgccgcggctgctgctggctcagcggggccagcgccatcggcggcgccacggccaccgtcacgcccagctcctccttcgccgccaccgccgcggccgcggcggcaagaggcgccatagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgaacccagctttcttgtacaaagtggtcccc

SEQ ID NO: 162 - DNA, 33436 bp, Lolium perenne
cggcgcggcccctggaagcttcgtggcaaaataggaccctgggcgttgatttcgtccaattccgagaatatttcgttactaggatttgtgaaaccaaaaacaacagaaaacagcaactggcacttcagcatcttgttaataggttagttccagaaaatgcacgaatatgacataaagtgtgcataaaacatgtagataacatcaataatgtggcatggaacataagaaattatcgatacgtcggagacgtatcagtgaaccattgcttagcataagttgttggtgcacataggtgaaccatagtatataggctttgggcttgacaaagtaaacgctagttttattccgcatttgttaagcccatctcgtaaaagttttaaatcgcctattcaccccctctaggcgacatccgtgtcctttcagtttctactagcaacggagagcatacaagatcacaaataacatatgacatgaatatataatcaatctcaacatagtattcaatattcaccggatcccaacaaaccaaacatagatgattacataaagatgatcttgatcatgtagcgtagctcacaagatcgatacatgaagcacaaagtggagaagacaaccatctagctactgctatggacccatagtccagggatgaactactcacgcatcacttcggaggcgggcatggcgatgtagatgcctccgacgataatttccccctccggcagggtgccgggaagagctttagcaccccccgagatgggttctgcgattgaggccgcgacagaacttttcgtggatggagactcgggtatccaggattttcccgagaagatgtataaataggcggaggcttgatgttggttgggcgcctggtgggcccagacctaccctaggcgcgggccaggtccaagtcacgcctaggggtggtctggccgacctgctgcgcctcttcgtccccctctggacttcgtcttcgtttcggtaaaatattgacttcggcttttgtttcgtccacttcggggaatatttcctgtatatcttttctgaaatacaaaaacaatagaaaacagggactgtcactatggcatcttgttaataggttagtgacgaaaatcatgtaaaagtgcaacgaagtgtaaacaaaacacatatgaattggtgtaaaacaagcatggagcatcaaaaattatagatacgtttgagacgtattagttgtcatcctgacttctcaagtagactgacccaacaagtcatacccgttgggtcgacaaacttaatatccgcgctgaactaggtccgtaaccatgccatgctaggacatgaccataccccatagaatcatcacactacaacgttctgatgttgttccctctgcgactcggcgtacatccacctccgggatgttgtcccgactaccatccctaaccacaaatctgccttgcccaaccaccataaatttgccacaccatgaggctaagaactccaatgtggcacctcaaagaaagtagcgacatgtgtgtcgctgctttgcgctctagcgaagcttaggttttcacccaaaaatcacaggaccactcgcgtgtgtagtgatcatagatctaatgatgcaaataaaagagaggatcaaagacgccaccgttattgacaccccacccaccaaagtcacccggagtgcaatccaaccgccaactcccgagggaacttgtactgcaggagcagcaagcagagccggctctgctccgcctatagtcccacaacatgaaggccacctccattttaaactttattgttagatttgtgtcatgtgatttccactaacacaccattcaaatgttcctctcattttctctattacacgttgaaaaataattttatgtgatttttactcttacacgttgaaaattcatttgtgtgattttcactattgcatggtactccttccgtataacaaaggatgttttaagtttgtctaaatctatattaaaatttagataaagttcagacatcttttattggacggagggagtacaaaagatttatcagggaacttcatgccatttgggtaaaattgaatttcgaatttaaacatatgatatgaaaggttttttttttgaacattgatatgaaagtgttgtttatttaattttggcacggcctctatgttcgtttctagaatacacgaacagaaatacgggtcgcaccggaccggaccggaacccggttctgccagacgaccataataaaaccacagcaccgcacagggcgagatttcaagtcctctgctccgccttcttgggaaggaagcaaagccgatccgccgccgccgaggaagcgatggccgaggccgacgatgccgcggccgcccgccgacgcaccgtggtcaccgactaccgcaacaagctcctgaactgccgcgagctggagacgagggtccgcacaggtaacacgacgcctcctcccctctcatgtgttctgggtgcttgttcgatctgtagggttcagactagttgactcgctccgagctatccgcgggtcctggctagggttgctggccactggaagataggatctggttttccgtgattattaggatggctgcaggctagggttttcggttttgaccaattcgagttcgggagttgcgcgcttggccctgccgcgaggacgccttggctgttcttctcggctaggctggtggttggttgctaatttctcgctggggatgtgattttgggttggtagggtgttctgaacttgatgcgggcctcgatttaggagagcttcagtggattttacaagatgggaacaggaggaatttgggatgaagtgttaaaccatcagatcctcaaattagatgttggcaaaaattagtaaaaacataacgataccaaacttttttttttgtatctacacaccttaagctgtagtctgtagatgctctgagcctcaccgaacaatgttgcattgaaattagttgtataagtaagccgcagctaggaccaagcatagccagtagaaagattccaagaacatccatggatggaacccaaacaaaggaaagactactagctaggaccaagcattaccactagaaagagtccaagaacatccatggatggaacccaaaccaaggaaagactactctatacaagctcatgttcataaccatgtcactagcaactcaatacaaggagcgaaggagaaaatagaaaaataaacagacacataaacatagaacttggatacatagaccaccaaatctgagatcgttgacacctagtatctcgatcaggtgagcaaataattaataatcttggatacaacacagaattagaacttgacagaggaaagaagagtgactacccagtatctcgatcaggtgagcaaataattaataatcttttgagccaggttttaattcctagttttgcctcggtctagcgcctatatcgcctaagcgcatgcctaggtgtacttaagcgagtggatagcacgattaagcgctaggtgttttgctgtcgcctagcacctagacatgcctttttaaaccatgcttttgagattgcaattgcctcaacagatcatgaaaaactagccaaatgttattatgatgtccaggtttagcactcccgacaaactactgacttcacattctaaacaaataacagttcaaactttaccatctcttggaagtaacctcacaaacaaatggaccagaataaccaccaaacagaatagggcaaacttctcaaagtatcgttaaatactcatcctgtcctaatctactattaaaagtgaaacatgtaatggagtgattttcgtctctgaccgacagtaaaaagattgaaatgtgtagtgttctcctatagttcctttgatctgtgtgtaattacctctagaatctgcatttaatccttgtcaagtggactgactgggattgattacctgaccacctgtgcctttgatatgccaattatgtactgaatctggcacatgcataataacttgtttcacttgtcctgttgtccacatgtgcaatggttcctgctggatcgttttttagataatgattttgttgaactatggatgacattattcacagcttgttagatagctgttgtttgataagtttacttatttatgtgcagctagggagaacctaaaaaaggcaaagaaagattatgataaaacagaagatgacttgaagtctttgcagagtgtgggccaaatcattggtgaagtacttcggccattggacactgaaagatgtaagtgaaaaggcttttttttttggttttgaaacaaaaatttctctgtacaaacaatgatacaagacatgcattctattcttaacaatcaatttcatcatcatattgcatgttattctgtgtagcaacatgaaatgtttttactcatggtaataaacctttttgttctcaaattagcgactgaaacctgtttttgttgaagttatcgtcaaagccagcagtgggccacgttatgtggttggctgcagaagcaaagttgacaaagaaaagctgacagctggaacgcgggttgttcttgacatgacaactttaaccattatgcgcactctaccacgcgaggtatatgggtattggcttttcatctatggtttagttgattatcttttgaagttcagtttgtagcatgacgggtttatttgctaactaaaaaacatgamcawmrtrckmaytctgccacgtgaggttgatccdgtggtctataacatgctacatgaagaccctggcaacgtcagttactcagctgtaggtggattatcggatcaaataagggaactgcgggagtctatcgagttaccgcttatgaatcctgaactctttctccgtgttgggattaaaccgccaaaggtagtttgaagaaaatttgttcttttgagataacatactatgctgttagskmakmsakaagmatkcmmyyttmwsaatcywgarwtgtwtctwmrtrywgskattamwcmtycaaagggtgttctgctctatggcccacctggaactgggaagacattgcttgctagagctatygctagcaacattgatgcaaactttttaaagaaggtttggttttttctttaacgctgttacatgttagcaatctcttatttggacatctttaatataatattttgaactattttgcattgctaatgcagattgtttcaagtgctatcattgacaaatatattggtgaaagtgcccgtcttataagagaaatgttcaactatgcacgcgagcatcaagtatgtttgattatgctttgtttctatgtatatcttcttatcctaaacatttcatttttgttggaaaactattaaaatcagaacaatgtaaacagtaaattgcatttcttcgctcgtgaccaaatatattttgcttccaagtttgtgcatgaagtagctgcagaaagtcgattcattaggcgaacaaagcaaagtaaaaaaattagcgtctgatactttgcgagaaaaatcaatggaaacatcttcactttgaagttactatgcatgtctgaatggcactctaagttctatrtctgtttcmmgtaaagcatatmatttagwcwastrtrtagtgtgwamtgwgstcrtctcattaatgwkwtattttctttytmtgmwcstkwkswcyarccatgcattattttcatggatgaaatygatgccattggtggccgaagattcagtgagggcactagtgcwgaycgtgaaatccaacggacattgatggagctcctaaatcagttagatggatttgatgagcttgggaaggtacatgttttttcttttctgtgtgcacgtgtgttatgacagcatgttatggtaaaacatattaacaactatgaataggtattatacagtgataatgatacgatgcttacttgtaactagatgattttttggttgatcaattgtaatggtgaactagttagttagttatggaatcaatctatcttgtcttatgagctactccctacgtcctaaaatgagtgtcccaactctttctagatttggaggtatttataactaaaatacatcatgatacatccgaatctagacaaagttgagtcacttatttatggacggagggagtaccttcttgcctacaaggtaaggctattgtatggagcagtttattactcatcaggccagttgtggaatggcaacttctgtgtagaaacttcagaaatgtattaaaacaagacattgaaaagttgaagatggttgtcactgattgcttgtctaatattatggcgtgcacatgtttggtgatgtacttaatgtctctccttttaatgtgaattatgcgtaataagagttttatgtgtaacaagagagctcttctgcctataaaggtcaagatgattatggcgachaaccgtcctgatgtcttggatcctgcactccttcgtcctggacgcttggaccggaagatagaaattccattgccaaatgagcagtcgaggatggaggtcctgaaaatccacgcagctggtatcgccaaacatggcgaaattgattatgaggctgtbgttaagctcgctgagrggcttcaatggtgctgatctgcgcaatgtctgcactgaagctggcatggctgaagccttaacacctatgcactgtcgttccagggcttcaacggtgccgatttgcgcaatgtctgcactgaagctggcatggctgccattcgagcagagcgtgactacgtcatccatgaagacttcatgaaggcggtgcgbaagctgaatgatgccaagaagctcgwrwcyarygcgcactacagcgckgacttyggcaaggaaagccagtactcaccattttagttttctgatgatgatgacaaaatgattgcaggcggtgcgaaagctgaatgatgccaagaagctcgagtctagcgcccactacagcgcagactttggcaaggaataagagatcaaagtaggacaccactgtctaaacttgagacgattcactgagcctttacttctaccatggcggagtttgtcatcctggcaataccagagcgatcatgtacgtttctgcattgtatatgctttgggatgtctgcccttgccgcacaagttcgtctcggcttcgttgaaaacagattccatgtacacgccggttcagtctgaaactggcctacttgagccacagctattcttagatttataacgtttgcttctcctagttgcttggaatcaagaaatgttggaaaaatgtaacaattgcaacttgtgtttctgtcttctgttactctacctggaatcaaggaatgtccaagaaggaacatttgcagcgtgtgctcctccctattactctaccttggaatgtgcattgttactttgccctgttgttagggatatattccttctgtgctgataatgacctgattcatgtggaatttctgattcatgtgaaatttctgtattacaaacttactcgtgctgaacgaatattggggttgcttgcccaaactttccctctatggctctatcggtagatctcgttacttttgcacaataaatttgttaggaaaatgctattttttcagacggataaaaaggaaacgtggtcggagtcgtcgccgccacgcgttgggtcgaaacgccctgtcctctcccatcgctccatctccgttgcaccaatctcgaggctggaggcgcgctcaaaaccaaaattagcgagcacctggccggacgcggggaaaccgcccccatctctcatctcgattcggcacacaaggaaccaaaccaaacatggcaacccaactttgatccattcccatctcaatttctccgtgaattcttcgcgcaacaacacaggattggaagatcgatcgatccccaattctgcattttttccatatatacggttttgatcgcatgacaaagctcaagagcgtggcgtccacggtgggggcggcggaggagtgcgcggggagcgctcggcagattgccccgtcgccgatgaagctgctggtgcgcgtcgtggaggcgcggggcctgctggcggtgcacgtcaacggcaccagcgaccccttcgtcaagctgcagctcggcaagcgccgggccaagaccgccgtcgtcaagaagaacctcgcccccgtctgggacgaggagttcagcttcctcgtcggcgacgtcaccgaggagctcgccgtatccgtgctcaacgaggacaagtacttcagcaacgaccacctcggaagggtcaaggtgcccctctcccaggtcatggacaccgacggcctctccctcggcaccgcatggtaccagctccagccaaagagcagcaagtccaagaggaaatgccgcggtatctttctatctaatctatctacattatgttttgggtttcctcttttgtggttctgttgattcggttactggttgaatctgtacaagcaaatcatgatatcatgcacaagaaaaaaagagcatattctggtaatcttggaaccatctaattatctgccatctgcaggggaaatctgcttgcgcatatccttgtctacacgaacgcacgtgtccgaagaactgcaccctctaccgcgccccacttcggacggcgtatcatccagttcagacaggtcaatcgggaccaagcgtggagctctgtcaaccaccaacagctacattgacctctcagccgtggccagcttggaccgaggatcgcagagcagcttcgaacggtcggcggatagcttcgtggagcagccgcccaggagcagcatcgaacaagcagtcaccgagcctggaacggccgctgaaactgatgcgatggccaacacgtcgtcgatggtagaggtcttgtctcgctatttctttcggaaacctgtcgacgccgctgtggctgcagttgtctctgatgccgagtcggtggtggatcagtccccggagccgaaagcgtgctctgaagaacgtgaaggtcctgagaatcgcacgccacctgagtcgagccttgatgagctactgaaaatcatggagtccaaagatcaaggcgctgaaatgccagctaaactgtctaatggcgttctggttgacgaatcttatgttactgcaccagccggactgaatacgctcttgttttctccaaattcagatttctggccggctgtagcagagcttcaaggaacaagtggatttcagattgaatcgtggaagatcgatagcaacgatggttgtttgcgaagaacattaagttacataaaagctgcgagtaagctggttaaagcttgcaaggccacagaagagcagaaatacttgaaagcagctgggaattcttttgctgttttgtctattgttagcactcctgatgttccttgtggaacttgtttcaagatagagatattgtactctataacgccaggtccccagttatcatctgaagagcaaacggcacaccttactgtaagttggcggatcaactttgttcagagcacaatgataaaaggaatgattgaaaatggggcaaaacaaggcatgtcagaaggttatgcacaattttctgaagtactgtcccaaaagtttaaagtagctgagcttgatgatgctaatgcaagcaaagcaaagattttggcttcactgcatacacaaaaagaaccgagctggaggctgattgtccgcttccttgggaacttcacattcatagtctctgttatcgtagggatatatattatagcacaccttcatttgtcaaagcccaaagcgatgaatgggcttgagtattttggcattgaccttcccgattcaattggagaggtcgtggtttgtgctgtgttgatccttcagggacagaatatcatgaaagtaatgaagcgcttttcgaatgcatggaaacaaagaggtagatatctcaagagccactatgttatctactctgaaacgggttcacatgattatgtatgctctttattagatttatgcttatgttgcacatgctgtaagagtgaaagcgctgttctaaaactagatgaggtgaattgtcttctactgcaaccaagggacattttgctctctatatatgttctgatattgtattgctacttggtttcctttataatatcagttgcagttaagaattattggcctttattttttcctttattaggtagtgatcatggagtcaaagctcatggagatggttggatactgactgttgcacttattgagggcagtggtatagtagctggtgattcctctggcttatttgatctttatgctgtttttacttgcaatgcgaagaggaaaacaagctcaattaaattccacacctctgatccaaaatggaatggttagtttcactccccttgatgttgttttgtcagtttgtcctcagctgtgaagagcaggcaatcttttttgttatagtatcgcattaactgaccttctcatatgcatagaatgtagctgacccatttgatgcttgaatttctagagatattcgaatttgatgcaatggatgatccaccatcaaggatggatgtggctattcatgattctaatcgatccgatggagatcccattggtcacgctgaagtgaactttctgacaagcagtttgtcagatttaactgacatatgggttcctcttgatgggaagtgtgatccagcaagcaaccctaagctacacttaagaatctttttgaacaactcaagaggaactgaagttgtcatgaattacctgtcaaagatggggaaagaagtcggtaagaaggtaaggacttcgacaactttttgtccaaacttttttcatcatatcttttatttctgaaagtacatatgacacaatgtgtagataaatttgcggtcagcacaaacaaattcagcattccggaagctttttaacctccctccagaagagtttctcattgatgatttcacctgccatctaaaacggaagatgccactgcaggtattacttttctgattgttttcttatgcgaaagatgctattatttgagttgtcaaagatttggtatgttgtctgacgtaatacttatatgagttcaacatcagaagaaagaagacatgtacatgcattaccatactaccatggagaatcaccgcgatagttttgcattcatttgacatttgccgctattttgtattttctccattttgtgctctctatagtaacaaagaaccgactctttttcttttaggggcgtctctttttttctccaagaataattggattctactctaatatatttggtcacaagacaaagtttttctttttgtgggaagacgtcgatgatatccaggttatccctcctacactgtcaattggcagcccatccttgatggtcatcctgagaaaggatagagggtcagaagcaaaacatggtgccaagggaaccgataacaatggaagattgaagttccattttcagtcctttgtttcgttcggtgatgctcacaggtatctttatccttcatttgtatgcttttgaggtccagtgagacatctggcccaaacttatacagtattattttttcagaacttacagatccaaatttcgaaacaaaagaaaataattaagatattgtttcctgaagttcaatatataacctgttcacgtgtaatctggcctgatgtgaatacactttggttcgcagtcttgaagcacgaagctgtcttggcctgataatgaagattataaaagaataatattttctatagttaagtatagtttttattatataaaaggtatggttgtaaacataggaaattctgaacattataggctttttggggatttgaacctaaggctgttgggcttggctcgtgcagagcagttaaattgaatttgatggagattttttcttatgaatattaaaacaagagtttgcattacgataggtataagggtcttgaccacagacgtcaaatcccaataagacaaggatttagatgctaggccccgggcggcccagcacttcatctttggtttgtgccaccaaagcctgccatgctctgtctttattgttgaagacatctcttttagaattcccaaactgccaagatgagcacttaaactggacgatttttaggaaccgcgcaatacttcatattcaggttcttctatacatacacaacctcatggtatataaataagcaaacggagtaacaatacatttatactttctatcgattataaatccgccgttcgtattttcgaattcttgccatgctactacctactaagctattctgctggtttggcaatgaatttattacactgataaacctttatctgacagaataattatggggatttggaaaatgcggtcaccgggtccagaacagaagggggagataatggaggagtctgaactgaaagaactcccggccgaagaatcagggtccttatttagccatgaagatgtcaaaatgtctgaaatattctcatcagttctctctgtggacgtgagtgtcacttttaccttcacacgagcttgtcactatccgttttcacactaaataatctgttttgggattccctatgcacatctgtattttcaggttatttggaaaatgcgatcacygagtctcagaacagmagggggakatratygaaaargagtcygawmysaaagaactccagsycgaagaakstggawccttatttacccatgaagatgtcaaaatgtctgaaatattctcrtcrgyyctytctgttgatgtygagtccttgatggagatgttttcaggaggtcagttggaacacaaagtgatgcaaaagactggttgtatggactactcgccaacagaatgggaacttgtaaacagaaatatataccagcggcaaatcaaatcaactacaagtttgacaaagcattgtctcgatctggaggagaagcaagcaccactcaacagaagtatgccctagtgaaccaagatgggtgggccattgaagaggtgatgacactccaaggtgttctacttggggactactttagtgtaagaaaccctttccattcttctatggtctggtacatatttcaaccattgctacaagtttgacaaavcattvtcaagatatggaggagaagcaabcaccactcagcagadgtatgctctagtgaaccaagadggctgggccattgaagaggtgatgavcctvcaaggtgttctacttggggactgcttcadtbtdcagctccagctgaagtatcatatggcgaacgtaccgbcaaaaccaaacacctgcagtgtgcaggttttgttggggattgcctggttaaagagcaccaagcaacaaaagaaggtcacaaaaaatatcatgtcgaatacctctaatagattgaaggagctattttctgaagtcgaaaaggatcttacgtcaagaaacggtaccctttttagcgcatctattgatccttaccgttctttacatgatcctaatatcacgtaaagtcatagcagaactcgcatcaaattaatgccaggaaagcaaatgtatatgatctttttcattcctacctatgaaatgaattattaccactgagtggaaactaagaaaataaatctggtgtagtttcatatgaacagtgacagaaaaagactgaaacaactcccttcattttgtctcaggcaagaatgacactgatttttctgtctgtgacaaatttctaggtgcaagctaacctgtgtacagcactaacagtaggttgaccattccatcattgcaattcgttttaagagcccagcagagaggggaataggcaaagtgtacatctcttgccgtctgcttgcggtgcgacatgcttcaactattgccaacatttttttgcagtagttgcacagacggaaaagtctgacagcgccaccacaatgtaaatagcttgtttcagaaacagttcgtttttctaaaacaatttctgatacggccttaaccagttgcctcataggaagtaaagtagagttgtatacgcacagctgacctgtattcgacaagtgttatagtaaaaggaagctaaatttgtttcacaaagttcttgtcagagttcgcgtgctgtaccgtgaaacaatcaaacaaatatgcgatatgtcatacatgtatactattttgttgctgttcatttttctgtactcctgtcaaagttctaaacagtggctgataccgacatatttagcatatcttatcttaagtatcattttcacacatatatggccgatatagacgatatatatcagctgacattttaccaatattttgcctgacatcttggcagatatggacaactgtgtattccctccatccacaaataagtgcacgtttacttgtcctttgtcaaactatttctaagtttgatcgacttcatagaaaaaagtagcaatatctgttgcacaaaattaatatcgctaatttgtcaagctgaacaaaatttgacttagggtaaagctaaaagtacacttattcctcaatggagggagtaggcaacacatttttcaaaatatttaagaaatgcatattgtcggtttatatacatgcctaatttactttcttctggtatcaatatatcttacatagacaaatcctactacaagtcacgtgtttcacataattgtttttccaacattttttactactttttcgaaaatgggcactttattacttaacgcaatagacccggcctctgcataactaagatgcatacagccgcacaaatatctgttacaaaaccacagtggtgttcgacgacaaaaacaaagtttgtggaagacaaaaagactagctaggaggatctagccgaaggtcacactgccacccatgttgggagaaaatatccctcgccgtatcctccaaccgtgaagacacctccgtaaagaggtctcggtgctccacacgctgcagtggcacccatgaacaaagcattgttgtgcaccggtaaatgacctgcataaaggaggaagaaacattattgaaaatcttgtcatttctacatagccacagagaccaaataattgcaatcgctcccatcctaataagactaataagacgcttaaacctaaaatccacgccattgagccagttgccaaataaattgacaatactacgtggtgggtataaggtataccctatttggacgactgaccatatagacctagcaaacttacattggaagaataagtgtttaatagtctcgtcctgggaaggtctccaacaccttagcgatagtatcgcttttgtggcgcactatattgtacaatgtcggatacggttctcggagtgtggtattatctaaccatttatcctcgcagaaacgaatttccgaccggttcttaatagagaaagatccatatggaaagaaatacttctttgtttccataagaccagcccaaaaatgtggatctcgtggtttccaaagaatttgagatatagcctttgagccaatatacttcctcttgaggagtgtttgccatataccctctttggtaagtaacttggatagccatttaccgagaagtgccctattcttgacctggatgtcttggatgccaagtcctccatgatctttgggtcgacacagcacactccatttagtcagtcgatatttacgcttctcactatccccttgccaatcttgattggaaataatccaatctttttaagactcctctaggaagttggaagaaaaatatcatgtatagtaccatgttacttagtatcgcattatgagaactaatcttcctccaaaggatagtaatatacctttccaactgcttaatctaatttgtagtctttcctcaaccaattttcattaggcattggtgagtctcctataatgaatcggaattcccaagtacctaattggaaattggccttgaccgtagctgaaaagctcagcataatctgcaacatgatcttgggcctcaccaaaataaaacaattcacttttatggaaattaatttttagacccgacaaatgctcgaatgctgaaagaattagctttagattccgagcattgtcgatgtcatgatccataaaaagtattgtatcgtcggcatattgaagaatggataaacttccatcaacaagatgaggaatgaccccttcaatctgaccatctgactttgcacgttcaatcaatacatcaagcatatcagccactatattaaatatcactggtgctaatgggtctccctgtgttagtcccttcttggtctggaagtatttgcccacgtcatcattgactttaatggcagcactcccacccgagacaaaactattgatcaactacttgattgggcatgcacataaatccttttgcatatagctatcttccatgtagttccaatttggcataaagatcttgcatcaccgggtggatcagtggacactttataagctatatatgtttttatgtttacacttttgagatttggcgcatgctagatttctagccaagaattgtgcgagtgttcctggaaggctgagggcgcgcgaacgccctctacgtcataccttttgtttttatccatttgaaggaatgcatatttaatttagaaaatatataatgggggatgaactagatgtttcttgagcaaggatgaacttagacctcaaacactatgtgtgtttatttgattaattgacaataattacataaatggaagtttggaacacttcaacatgaaacactttggagaattcagaacaatggagataaaagcacattatttagcttgaatttcttccacggaaactgcggcaccagctttactccttcattagcatagactggcagatggcatcgatctctacagcgcattcatttagcctgcaatgacaagtaaaacaagtgtatttttcttcagaaaatgcacgtgtttgctgcagagataccagtttaagagatcgaacgttgacgagttatatatacacatgtacctctgcggtctggtcatggtacttgccgcggactttaaactccacgttgttgaagatactgttcatcagaatgtcagcagaatccgtgcctgaaaccgcaatgcaaattagttaagtacgtagtgggagatggcataatataacacttgacgatgggctggaccgagacctgcaaggtaggctagtcgtacttgccctgaacgtgatacttgcacatctggttctgcgcgcagtcgatcagaatttccgcagagtcaatacctgcaagataacctccatggacatagccattgtagtgctcgctggtgtgctccccagtgaagtagacccgccccaccggcgcctgcagcaatcaaatttaaggacatcagacctagccggccggagccattaattcggtgatggacatttcaccatcggtgtagttgagatctcgatcaaaaattcaattcaactacagtgtgagtgtgtgtctgtggctacccgaagctggtcgtattcgtagcggttgacgccgatgggccagttggagtaggagcccttgaagaagcggttggaccaccacctgggcacgtagatatcggtggcgtcggggacgtcctcgtcggggaacatcctccgcagcaccgccacagcctccgccatggtggtgttgtccggctgctgctcgatccgccgcgactcctggtccgtcaccgtcacgaggagcacgttggcccccgggtactcctcctcgaaggactgccacatcccgtagtagcctcgcctggagctggcgtagacgaagaactgcttgccttcgcccgtgggccagaacttccgagggaacttgaggaagatcttggtgtacactgccatgtcgaaccggtagatggcgatgattttccatgcttgcaggtcgatcgacatagcaaatgtcaagagtatgatcgagtagttagcagagtggtgtgttgggtgtgagatggcaagctggcagagaccatgacgatagtctgcctggtacactgagccgtcctccgtcttgacggtgactccgctcgaggagtaggagatctctcgcaccaccttgttgagctgcaggcgggggtcggcgacgttgccggagtcgtcggtgttgaggtactggccggcgaggtagtggacgacggactcgtagccccgtttgtcggcgacgaagtagacgtcatctccgaagtcgctgaaggtcctctggggaacggcgttctgcaggctggtcacgcgcggcggctcggcgtactcgtagtcatacaggtagtagtctaccaccatgtaattagcgatcccgcctccactattctcctctcgcagaaacccatcgctccccctccccagcacgcatccgtccccggcgcccccatcccctcctcctcgcggcgccgcctccccatcccgcctcctcgccacgccgtctcctccccccaccacaaacaacacgccgcctcgcctgcccatcccgtccaacccacgccgtcgtcccgtcgccgccacatcgtcgtcgtgcgttatcccgccggccactcgccgcctccccatcccgctaaacccgcgccgccttctccggccgtcatcatcccgccgccgccacatcatcgccgtgcccgatcccgccagccactcgccgtcgccgccacccgtcgctcctccttttgctggtgacaatcccaccttcggcaccacgggatccctctccaccgcgccgccatggatcctgcatcttccgctatccataagaaactagctagtagctgatttacgggcagctgaggcttgaactgtatgagatcgctctgcaggactcctaggctcgtggacacgatcacgtagtccgcgctgtacgacgagttgtcctctgtgctcacgaccacgcctctccggctgtacgagatctcccgcaccacctgcagcattgttcaaatttatccaaaaaaatattaaagatgtggtttctttgatcactcctacagtactatgttcgtatggagataaattaattcatcaggtttcaattattccagtatatgaatgaattctggaaagatagtgtgtataggcatataggatgaatgtgcgggcagaattcatgatgaaaaaggcgtggtcaatagggaaaatgagcatactggaattgagcagggcccattatttcgactcgaaactaaaatgaaaatgttccgatttccatttgcagtatgcatgagatgagctggacgaaatatactctaattattgtgctacataaatttatctgtgtagcacctttattgcatgtatatctcaactgcccacgtcgagttcaacaacactgtacagtgggcatccccgttgaagaaagtgcctcgagataacttgtactttatgtccggtgaaaacccatgatctaactttggtgtttacactggtcgaagatggcgcttgtacactactcctttcctagatgtgccgttgttggtggacctctttcgccagcttggtgtgtgattatttttaaataataccattttttaatcattttcaggaataatgcgtggtttcaaaaaaaaaaaatcaatcggcggacggcaggccgaccgcaggtctcagagggtcctgaagattggaacccggtcggcggacaggctgccgatcagccagccagcttccgatcggcaagcacgttgccgacgaggtgagctcgtggcagtacatcagtccatagcctccttctttctttattttccctggtggcggggcgtcctgatctctcctgattgatgtgtgcacatgctaagatgagacctggtcggtaactattccatcctcatgcaccaagcgatgtgtgcacgcactgagaagagacgtggggcaaggaaaagtgctcagcatgcaaggaaaactgctcatatgcattcgtagttcttgattttgcatggaggccaggctagtcagtttccgctgagcagacaaggtctaatcggcgtggcctggcatttgttcaggccgatcaggtggttagtttcacttcgaccgatcggcacgcgctgaaaaccgatcggtcgaaagatggccgacgaagtcagaaaattgaaatttttagaaaacgcgtattattcctgaaaatgatttagaaattcgtattatttttaaaaatcgcccagcttggtgttgccaatgggggtggttgaccgctttggcagagccatgctttttgtgtgcaacattcgcatctcaactaggtctgaatattacgatggtatctttttgatattagtatattttctttattaaaaatatacgtacaaatgagatataataagaagattaattttcattagcttcattagcatgtgtttggcccggtgatggactatagtaatcttgtttagaaaccggtttatacacaaacgattgcaatgcaattcatcaaatttcacaatttcagttgcatgaattttagaagaatttacataatacattataaaagagggcgtatccaacaagagaaataagccattgtgcccacatagttggtctttagtagtgagtgtatctgtttggtggtagcgtgtgggtttgagtatgcatctacattataataggtgtgtcacaaaaaacttagttttgtcttatcaaaaatcagtttattagttttacatattttattttttatatatacccactatgctcataactggatggcgcttagatattatcggtctccagtacaacatcttgaccattagtttttgtaagcacatcctaaaaccatggaaatttaaaatataaaagaatattatttctcacaagagatcttagggtactatttatactttgcaaaattaattaatttctcggttttgctgattctcggctgagactcgtagatcttaggattgaatcgtgatttgtaatagctatgagttgcatatgatttgaaactaagattttattcagctacagatgggattgtagctgagaaaaatgccttgggcagttcgatttctttatgactcgtgcaagttagggttgcaattgagaaaaatgcaccaaaccgttggattgtttcgtgactcttgcaattcaccagttggaattacaattgataaaaaatgtctcacgatgagaatttcactcccttaattttgtattttttggtaattcaagctagaaaattcatgcaattttgaccatctcctcaccacaagtttgtttatattattaattattagtatataaaattttaaaatgtttttctcttcggggaaaattagtaaagttttaggcttttccgaaaatcaggtggagtaccttgttgagttttaacctaggatctacgatgttcccggcgttgtccgtgctcaggtactgtccggcgatgtgatagacgagggtctcgaatccccgctggtcggcgacgaagtgcgcgtcctccccgaagtcggcgaacgtggcggtgggctcagtattctgcaggctggtggcacgcggcggctcggcgaactcgtagtcgtacctgaagtagtccagcgccatgtccaccggcgtcgccggcccgttcggctggctgcaaaaaaacagaagaggtctctcatggacatggtcaactgatcgatgagtatataactgtatatacaggctaagaagacgcacgtactggttgaatatgcgctgcatggccaagatggagatgtcgtcgcggccgctgggatccatctccgcggcgagcttgccgcccagctcttccacttcgtccccacggtccattttcttctgcacgtactcctcctcgtacaggccgccgctggttctcgtcaacaatagtacaaagcatgagattaggtttaacatggatgctgttggaacaaatcttgttattagtactaagtttagagtttcagcatgtttcattttgattttgttgaagtctgcatgtagtagtcgtctcagggtaggactgtttatgcatgtcatcatggtgaagtggacggatcgatcggcaatgttgcgagctgatcggcggtcaagagaaaccactagttgcgagtacatgttgtattcagtcaagtcctacactagtttgagtccaccgtcagtgcatgtagctaaggatctatacgttgggcgagccgagagactagcgctatatgagctgagttagttgtggcatatacgtgatgttgatccatagagtggctgcatgcgcgtgtgggcagttagtgttagtggtctactagttagttggcacaagtgctgaacgtgcgtgcgtgcagtaagtgtggagtagaagtcggatcaaactggtgtgtggcttgaccgtgtgtgcgtgggttatgttataaaagcattgtaacctcagttgtttcagtcgagagaaatacagagaaagaggcagacgtgtgttgccgagaatacctgtgtgttcttctccaccatatatgtatgtgtgttgtatcttgggcaattctgtcagatgcaacgcttcgttcatcatcagtcctacaacgatcgttttcgatggagtaattagaaccacgacgtcaaagatccggcgtcattacattaatttctgataatttttaaacttctcgttcacgtcatcagtatatgactctgtctgtagttaatttggaccctctttttaatatcgtccaatcattagaccacatttctgcgcgtgcgtgtcatttccacgtggtttgggcagcgtgcgttgctgttcatcaatcatcagttattattaggtgcggtaatatcgacagttaccggcccatcagctaaatcttttgttttcgttctcagcacgtgcatatatgttcatctgtttgggcatgcaggcatgcctgtctaatgtctatgcatattctagataatcagttttttcttcgaaaggtcttaatcgtcagtttggcagcatagatgtcttatatatacagtgaacgcacgtacttctccttgtagacgctgctgacgacgccgtcgaagtcggagtagaagttcctgagcttcagcgtggagttcaccatgggccagatcgggttgatcttgtccccgttgacgccctccacccagttggcgccgatctccacgttgacgccgctgaagttgtgcttgtgcatccgcccgccgatgcggtccgtcgcctccaggatcagcaggtccctcacgccggcgtcccacagccgcttccccgccgagatccctgcaggcaaagatgtacaacaccgacgacatttcatgtgacgtgtatgggtagcaaagacgtttccaccaaaggatgcgtgcatgctgattaggtaccggacatgccggcgccgactatgatgaccctggggcctctgccggcggcgagagaggcatgctgtgcagctatgagtatcaacactgctgctatagcagtgacaaaggaagaaggtttcatctttcttctcacactaatctctctggccttgccgcgaatagctagtttgctccgatggacactatctggttaagctgcgcatctgctctccggccgagccagtcagtgtgcacttatatagggccagagagcagatggctacacaaaaccactatgaattaaagacgcgggaaccacacacgttccatatagagttaatacgattgcgacgaaatcgaatggtagctagacacggtggatggaggacgatggtggcgccgatcttatcacatttgttggcttcgccaaggtgttttgaggcgtttctctgggatgagatattgcgatctaatcttgtagtataagttaaccagatttgctaactcccagtcgactgagaataatccttgttaacatgaaaaccgttggattttacgccaagatatgtgcgtgcggattgcggaatcatgcgtgacgttgtgattgtcgaaatatgatgcttgcgttgttcggcattctcactttgttttgttttctgtttgccccgtcaatgtgagtactgagtagtgcagatgggtcttcaccggcggattcggtatttttgattctttttctttctatgctcattttttcgataaagggggatatactaataccgcgaagataccaattacacccagcatctgcgacaacgtagtgctctaatagcaatacggatgcacacacccaaaaaaagaaagatgaattacagaaaagaaaagtctcgcttcagtgaccaattccttgcagtagcggacgaaccaccaccagaatagcaccagaaatccatcaactccaaaagcgatgccttcaaggaaacattgcacaagcgtcgacatcgccctaatcaaagaccataggttttcaccacggagaaagtccgcactcccaaaacaatgccttttcaacaaggacattgccatgcacaaccaattaaggccagaccttggattttcaccctgcaagtttatacactgaatttctcttgtgttgttgccctcacttgctaattccgctgccgaattcacgaatcacgaagccagactcactgcaccaccaggacttagaactccattgccaatccccagttctcggcttccatgccattatccgcgtgtcagtttcccatggaaccaacatgtcccatgatggcaacagaccgcagagcttcgcaacgcctcttctgaaaccaaacggtcagaataaaacatggttacacgcgatagaaatggcatgaaactctggcaaactccaggcatggcgtccatttggaatacgccggcggattcgtatggaactcagcatgcagccctagatccaagacagctagtgacaacaaaatcttcatcacggtgagagagaagaccaaggaccgccacctttatttaatactgcgccggcagcccccacgccaccagctagcggctaagaagaaaacaaatcctagatgcgaaaacatgggccgacatccgcatagcaggtaggcaccacgcaacaccgaggtagggcaagatcgcttccagaatggcccaccccgcctccagtgccatgccgccgccaactcaatgccgcgccaccgccggccatcgctgcccatgcctgccccacctccatccgctcctccacgacacgtccatggcccaccaaagtcgtaccctgccgctcgcggagatcaatcgggaaagccctctcatgcccttcgccttcagcaggacgggtgtcatcaccactgccagcggaggcagcggcctgggagggccagagatggggggctaggcggcggctggagacctccgggatcgcccgagcggaggcggcccgggaggttagaattatgttgtgtgttctgtctcgtttcgttaacttttgtcgaatgccctgaaaggagacatacattctcatgcatctctctctctctctttctatctatctctccctccctctctctctctctctctcttattttgcacgttgctaatatccgtcgatctatttataatccttaacaactacaatcattcgagcaaaccaagataggcataacacaagatatatgagttttaggagtagatttcattcattttccttgaaaatctaaaaatcatccaatagatatcaatacgcctctaataccaatacaagatggtaatagatatgaatatagagaattaattcaaccatcacatagagatggacaaagatggccagagttcaccatcaccacctaattagagttattaaaagccattgttcatgaatagatagaataaagttcaaattaagacactacaagaaaacgggcctttaggctcgggacggcctctagtcccggttgcccaaccaagactgcggaatcgggactatatatcatgggggagtttgctctatgtattcaacttctttgttacttaaattatttatataaactctctcaaagagattatcatcaattaccaaaatgggggagaatgaaagtgcatagagtctccatgtgtggttttggtaattaatgacaatccctatggaataatgtttgcattgagtcataattgtaggagttgtccataggaaatgcttggaccatatgttggcttcaaggttgcaataagaagaaataaaatgaaagttcaagatgacccaactcgaagagatcatatgcttgaagcttgcctttcatatggtgatcatggatatgtgaaaatatgccgaagaagaagctctcccatagtggagtatgggggagcaattaagaatacttcatcaagccagcacaatcaagaaaggtgttccatcttgttgcggtcaagatcatcatcatcgagctcaagtggaatgtgcaaggttaaggttatatctttatagggtttatttcttaccggtctcgtggtttagttgggacaccgggttataggttagttgccgcactatcaaggggctctctagtgagtaacttgatcgtatcgttcggagagagttcaaacctttgcatccttgcataatctttcttggttgttatttggatcttatccatatggtgttttagagcttgtacttattctcatgacaatccctagttcatcgaaaacacattccacatgaaatacttgttgtgttttcgatattggagtttttcccggtttttcgttttgagaggtttcacctctaaatgcatgaaaaatctaccccacttattctttatattttcactctttgtggggtatctcgtgtcatcctatttacaactaaattggttttacctaaatctgagttttctaactcaagttgttgcaatttccttattagaggtgttagcggtttagctcttatagataggttaaaacttccccattttgatcttatacaccgtagatggactatgatttttccctacatgatcttgtagatattttcgttgtgattccaatgagcccgagatcatcaaatttggagtccagatgtgaaaatgacgacgtttttggtgtgcggtacgctgccagccgaagcggtccggcccccggtccgacgaaacggtcccggctctcagattagtcgccggaatggggctggggccggccggacaagtccggctgaccagaatggtccggctaggcctggaaggtccggccgggtgcgaaaatggagcccttttctccaaacggctagtgctcctcctcccatataaaaaggggccttcttccccattgagcggctgcttcttctactctctctctactccattgttgaccttgagaagcttcctctccctataatccctccatgattcttgctcatatttaagggaaagatagaggagatctagatctacatcttgaccaaataaattcctctctttgtgagggaatccactagatctagatcttggagaaatttggtgtacctcctcctatttgttcttcctctcttattaccccaatatcttttgtagctttgttggaatttgatagagaatgacttgagcatctttgtggtgttctagacgttgcatttggtgcatcggtttgacttctccacggtgatacgtgaaggtgaaagttcgtgagacatacacttcgggagcttgttcccggagcttgttcctcttgggtctttgaaccatagacggcttagtggtctttgtggtgttcttggggcctccaattaagtagctttgtgctttggggcttagtggtattcttggggcctccaattaagttgtggagattcctcaagggcaaggcctttgtggcaatttattgggagcctccaattaagttgtggagatagccccaagctgtgtgcgggttcggtgaccaccctaaggttccatagtggatcgaggacatcccttttggtgggaattctctagaagaatacggtggccctcgtgcatttggagtgacttgtcctccacaccgctccaacggagagtagcactcgcaaaagtgtgaacttcaggatacatcgttgtctccgcctcacttcggttattcctatacccgagctctttacttatgcattttactttgtgatagccttagtgattgaagttatatatcttgctatcacatagttgcttgaattgcttagcataagtcgttagtgcatataggtgaatcctagttatataggttttgtgcttgacaaattaaacgctagttttattccgcatttgttaagctatattcgtaaaagttttaaaccgcatattaaccccccctctaggcggcatccgtgtcctttcaggtgcaccctaattacatgcatgttagaacgaccttgtctccatgttcttggcattctcttcaagattgccctttttgatattttattggtttcacatgatgatccacctaacgtctccgctccaactcacggaatacagagtggtgatgatgcaattttctctctctaatgctaacacaaacatcaaaggttggacccacacgaatcttgtagcaactcatcttgtggcagatcatgcatgcacagctaccctactagacaggagacaattttcgatatatatatatatatattatatatatatgcatgcttgttcataagagaaattatattatatatgcatcagcgtttacaatatgtagtagcgtagagtccgtatacgaaaatttgtttgaaatgaaaaataattggagcacaaaatgcaaacacaaaataaaggggctaaaaccctaaaccctagcgcttcctttagtcccggttaaagttaccaaacggtactaaaggttctctaccccgagcgtgcttcacacacgatttatttaaactgagccgttttctctacgtctgcacctacataaggttagatcgcacacaattcatctttgaagaagagttcataatatatttggtcttagaacggagggaaaccaattaatgaaacatgggttcccttccttttacaaaagaccatcaataatatttgggcattgatcggaagagcatcaatcaaatatgattgcccttcctgttacaaaaaggtcggcgttaacttcacattacatacatatatagggcctaataaagttggtaataactatgtcatgtactacacatcctcctcggcaccagaggacacgcgtagatggcgctggtgtctgatgcatctccatcgtcaaaggctacgccctctccggagcatgatgccacggtgtcgttggcgcaatggccactagtgcctgatgattctgcttcgaaggcagccatgcgcctttccagcgcgttcatccacaactcagcaagctcgtcggcgggaaattacagaacacgcactgcgcggccggccttcttacatttcttcttagcgcgtagccaagctgcagccggtcctcgcggagagtctcgaaggagtcatccaccacgctatgcatagcttcttcctcacgccacgtcaactcgatggactactcgagcaccatcttctcctctaagtcctcctcaatcctggctagataatcctcgtctgcagcgtgcttctcctactctagagggtgatcctcctccgagtcatgccccgtgaggtcgatgatgcttcccccagcactgatgtgttgtggaggaatgctcgtcctccgcatctgacggtgcaaggtcgatgcaacctagagtggattggtagggaggcatggtgcaaaggtgggtaggctgccagagagaagagtgagcgacgcatttataggcgaggaggtaaacaaggcgaacattttgattttgcatttcaaacaaaatcagttaacttgcgagaacatttgatgaccaaaatatccgcaaacgatttcgcggacaaaaactatttgcacagtatagctgacaacgtttgcgataccttcctccgcatacaattctatttgaacaaattgtttctgatattttatcgtgcacgtatttggcagccacatcattgcagcccatctccgcgcgctctttcatgtccttgaaattcatttcactttcttcgttgtcttggttgttagtcagttggacggactggtcatgctcctcctcggccatcagaggggcttggctctaaacggcgacgttgtgcctgcggtacggcgcgacgcaagataggcgagcggtcttcttggtgcgaaccattacaaagtaaactacatgtgtaccgtaatggtggggtgtgccaaacattgcggcggtgtggggggggggtctgtagcccggccaaggatccagcttgtcggcgatgtgtggcacgccggaggaaggcgtagaagccagtcgtcgactgaaaattagacacacgacttttacatactgtaccatttgagtgcggcagaggagaagagacggtcaagatttaaaactcttcgcaaaatattcactattcacacacgataactttacccatagtcgcgtgggatgaaggccctattcgctgaccattatttttaaatagcccgtttgtggactcttcctgactgcccggaaataacttccgtgtgctttcatgcattcgtataggcctgcctggagaccaagcacacggttcgtggtttatggcgtcatcgttcggccgcacaatacacaaaaaggtctttctatgtgccactgagtccttaataggcctgatctgtactagtgatgccctgacatttttaaacgccgaggtatgcccgcaatagctgtgctcgcactagcccggcaaaacaaatccaccacggaaaactacgttggaaaactgtaggccctatttttttcacacgacatatccctatccactacgcacgagacgactaaaactcctcggtacattaacaaacaatatttttttttgtcatgcatagataaggtggggcgcatttccccccgtgtttcgtgcacctgttttcgatagaaaagttaatcgcaattcagtataaatatcagttcatccattctgtttaaattataatttccatgtcattaagattgataactatatttcattacataatattagagtgctattgtttgacttaatcaacatctaactacctaattaacactaattagggaaaaaactcctatttctagttctccatcaccgctaatctctggttgccttacaccatgacctcgccgccatacgccatgacctcgccggcgatcccatggacctttgggagttgtttttccagccatatttatgtagggtctgaaatgaagagaatcatgattttagaagaaaatgaagagggagtgtgaaataaagtaagggcctaatggtagtgatttagtgcgatgtgaggtggggattatgaacatttaccggtgtggatttagcatgtcgggcaaacagagagagggagtgcatgagatctagggttcccagttgagtgtggagtgcttgagatctagggttcatagttgaacggggattgcgtgagatctagggttcatagttgagcggggagatcgtgatatctaaggttccttgttgagtgtggggagtgcatgagtctagcgttcatatttgagtgggggagtgcgatggtatcatgggttgttgggattgaccatagctaaagcatcactcgcaatgttttgggagcgattaatcttaaagataatacacagtcgaaccgtccggcaaagtgccttgatctaggcaacaaggtgacccggagaagaacagtccattgcagaacttgtcacaagccgcggcacatcagcactacctgtttcaatggtgattgagtcttggctccattgcaaggcaaagggctatgccctccatacactcacacagctcagcttctagagctaactagcagtgctgcaaggccccgcatgcagagaagatgatgtttcctcagaatctcctaagatcttacctttcccagttgcgctcgtctgctccagaaaggagccatccacactgagtgacataggcatccccaatgggcctaccgaagatggtacccggggtttacagaaggcccacaagtcgaagaatatgaagttcggaagcccagttagtattaaggaaagttagagttgtattaggaaatatagagacttgtaattttacgggacgggttagaaaccctcccggactctgtaacttgtgtattacgaatccctcggctccgcctcctatataagggggagtcgagggacaaagagaggatcgaatccattgtcaacataaccctagttttataatcgtcgagtacttttcggctaaaaccttcgagatctacttgccctctacttccaacgaaaccctagtctacaatacgtagacattgataagttaataccttgtcaattggcaccgaccgtggggattagaggagacaaggagctgatctcgatggcacgttcaagatcgtcgacttcgtcggtagcaagcaacgcattggatcgaggtaaatggatcgaaactgatctagttgattttgttcctcacccgccctcccgtttggatgcatatgcgtatctggaggagcccatggagatgacgttcggaaagttccgattctatgtcgagaaagaaggatcgtatcgtctcgaagttccgatctcgtcgggattatcggcggtcgattccgacttttcgtcaggcgaagaggagattttgtcgccacgcttcatcaacaccgtggcaagcgaaaagctcgccaagatcttcagcgacatgtccttcgagtcgtctgcggactctgatataagcagtgactcagacagcgtcgacagcttcaatttcatcgacagatctattgttattgaaaggtcttcaccaatctatacgatggtgtcaccaatcctgacaaaaatcaaaattcaaaatatcatcagatctacgcaattgaggaaaaaaaccgagcagagtcggaaacatcagaggctttcgacgatgtgggaaatccatatgtcgatcccgctgatctcacgcgaggtctaggcactaaatatgttgggcctacaccacgtctaagggttcagctcccgcaagaagcgtaggacagagccgcaagagccatggatggtacagaaccaatgaccacaactgctacggtagaagaattgcaagcttatcaatacagacttgctcgtgttagcagagagttagaaaaacagacagccgcattaaatagaagaaaggaggcagcttccgcgtcaagcaggcgaagggcagatttaagtcgacaatcaggaaattcgggagatagtgatacgtctcaaacgtatccataatttcttatgttccatgctagttttatgacaatactcacatattttatacacactttacatcatttatacgcattttccggcactaacctattaacgagatgccgaagcgccagttcctgttttgtgttgtttttggtttcagaaatcctacacaggaaatattctcggaattggacgaaattaacgcccagggtcttatttttccacggagcttccagaagaccgaaggggatacgaagtggggccacgaggtggcgacaccacaaggcggcgcggccaaggaggggcccgtgctaccctatggtgtgggcccctcgagcgccccccgactctgcccttccgc

SEQ ID NO: 163 - DNA, 12863 bp, Lolium perenne
gagaagtagttgtgcttgatacgaccccctcatacgtacgtacaggtgtcatcccagccgtccatcctcaagtcggacggccccgatcacccgtggaaacggaagcgaaccttggtcccgtcaaaccgtccctcgtacgccagacggagtccctcctggctcctcataataccctgcatctcccctctctcttctccccaaacgacccaaaccccacgcggcgacagaacccagcctcctccagtcctcctctagggtttgcggccgccggcggcgaacactcggcggcggcgatggcgggccaggggcaggaccgcaagaccatcgatctggaggaaggatgggcctacatggagggcggcatcggcaagctcgtcaacatcctcgagggcaagaacgagccgcagttcaactccgagaactacatgatgctctacacgtaagcccgcctcttcccacgccgccggccccggcttctaactctgccggcccgattcgatccgatccgttgctgatctagggtttccgcctcccctggcccgccctgatttgttttcgtctgttggcgcaggacgatatacaacatgtgcacgcagaagccgcccaacgactactcgcagcagctctacgacaagtaccgcgaggccttcgagaagtacatccgagacgcggtaagctgctggttcccccttcttccccctgttttttgtttttgttactgttatgccggtgcttttggttctctggtccagcgaatcgacgcgaatctgattaggatttgctttctgtttcgaacgtgcacctatggttgtgctagtactggctgcgaatgattagactatggtctttcgatttatatctactaacgcacggtcagaccctgtcaaaaatcgttccttgactatttgaaacaagctgactcccagtacctagtaactagtaggtttagttcagctagttttgcgtggatgcatcggtaagtttgcttttttacttgacaatgtgctatgtttgtcagttcagttaaggtccctccttttccggccaaagctgttatagaatttcttttgccatcctagatagaagctataaaagtgaaacctgtattgcacaacagtttgcagtgttttccttgcttaatttcttgaggtgaatattacttttcttgcattgtacagctggaaacaatggcccttgataggtgcatgataacgcaaactgttagttctatactatctcgtcatgcatgctgatttatgaaagtaacttgtattcttgcataatccattggcctcactttagttttctcctagtaatcccttttgttatttgtgatactgtgacctgattggatgatcaggggattaggaatccagggtcataattatgttatgggtttctgacataagtcacccacatccaactttttctccaattatgttgtactcgttgtgttatcctgttttcacggtttaacttgttgttcaaactactacaggtcttgccagcaataaaagagcagcatgatgagtatatgctaaaacagctaaacgtaaggtggaagaaccataaagtcatggttcgctggctttcacgtttcttccattaccttgaccgatacttcatcacccggaggtctcttactccacttaatgatgttgggtttatttgcttccgagacttggtaaactgcctttttcttaacttcatcctcctgtttagtgcacactaagttttttttttctcttctaatcagtcaactcatggtaacagatatttcaagagatcaaaggaaaggtgaaagatgcggtgttagttctggtgagtctttgcatccctagatgaacatatatcgaatgatttgacaacatttaacagacttttgcgacaactttcttctgcagataaatcaagagcgtgaaggtgaacagattgacaagaccttgctgaaggacgtcctggatatatttgttgaaatcgggttaactaccatggagttttatgagaatgactttgaagatttcttgcttaaggatactacagagtactattctgtcaaggctcaaaactggatcgttgaggattcttgtccagattacatgataaaggtaccttcaataagacctttgccctgcataatatttatgcatgtatttctttttgttctatgtaatagatttgctgatgcctctttcattaggctgaggagtgcctgagaagagagaaggagcgagttagtcactacttgcatattaacagtgagccaaagttgctggaggtctgttaaatgtttgctgtacctattcaaaactatttctccactagtatatccactatgtattctgaatatgcattcatacttttgtaaccagaatattctaatgatcttgttcgagaaatgatgcaaaatagcgcagtctgtgaaataattttatgtaatcatctttccttttcttacagagagtgcaaaatgaattgcttgccaactatgcaacacaacttctggagaaggaacattctggatgttatgcattgcttcgggatgacaaggtttgctcagaacaaggcatatatatttctatacagtatacataattattcatgaacgcaattgcccactcattcatcttttgctacaggtggatgatcttaaaaggatgttttcactcttctcaaaaatcacccgtggtctggaacctgtttctaacatgttcaaatcggtattgactatagtgcacattatctcggctctcctttctgttgcttgcagttcactgtaaactataattgaattaaacacctttgcagcatgttacgaatgagggtacagctttggtcaagcaagcagaagattctgctagtaataaaaaggtgcagtatttgctcccgccattgcttcatttctgcacttattttttattgtggttcagtttttgaacaattcaattcacactgtagtgtcatgtagctccactgtccagtgacaccattctacatctacattaatactcttaaaatagttgagacctgactattggagttgccaactggcgttgagattacatctgacattttgtttagtacttgcgtttggtctgccttacgattgatggatgagctcctgccacctactggtttagttgtgtcatttgatttattaattttctgtgaataagtatgctaatattagtcatttgtacagccagagaagaaggagatggttggaatgcaggaacaggtgtgtaactcgatttactgcacctctatcacgagatttgtttttctaatgtgtgttatttgccttttaggtttttgtctggaaaatcattgcactgcatgataagtatgtagcatatgtgacagattgtttccacggccatacactcttccacaaggtttgctggctgatacggttgtattccattttgcccgtatagtagttaaaattgccgcctcatcctcaaacttctctttgttcaggcacttaaagaagcctttgaggtcttctgcaataagggtgtctctggcagttcgagtgctgaattgctcgccaccttctgtgacaacattctgaagaaaggctgcagtgaaaagctcagtgatgaagccattgaagatgcccttgagaaggtacaccactgtcttcggatttactgttatcataagtttgtagcagaaagaactctggtttgatagtgaataactttcaggtggtgcgcctgcttgcatacataagtgataaagacctctttgctgagttctacaggtgatttcttgtaaccttacttggtattttgcctatttagcctccatatcaggagggtttgtcttgatttagatcttagtatttatcttcaaatgtgtggaacaatttacaggaagaaacttgcaaggagattgctttttgacaagagtgctaatgatgaacatgaaagaagcatcctgacaaagcttaagcagcagtgtggtgggcagtttacttcaaaaatggaaggcatggttactgaccttactcttgcaagagatcatcaaactaagtttgaagagtttgtagctgaacatcaagagttgcatcctggggtagacttggctgttactgtcttgacaacaggattctggccaacctacaaaacttttgaaataagccttccttctgagatggtaagataacctttttcttgtggatttagcagcatgagttacacgtatttgttaacatgacagtatgaaacccaggcatcaaagctcatctttataattttgaaatggaaacttatacttctcaataccttcaggttaaatgtgtagaggttttcaaggagttctaccaaacaagaacaaagcacaggaagcttacctggatatactcgttgggaacctgcaatatcaatgcaaaatttgaaaccaaaactatagagctcattgttacaacatatcaggtattttgaattaagtcgtatttagtcgctttgccaaatgtgtacttctaagttgtaacctgtctgacattttgacattccttttcttttggcaggctgcgttgctgttgttattcaatggagttgataggcttagttactctgagattgtaacacagctgaacctgtcagatgatgatgttgtgcgtttgctccattctctgtcttgcgctaaatacaagattcttaccaaagagccagctggtagatctatttctcccaatgatgttttcgagttcaattcaaaatttaccgacaggatgagaagaatcaaggtactgtcctagatttttttttttggtttcttagctgtcgtactcccatgggattataggccatctgctatctgcagtgatgcttttcttatgattgaatatttgacataatgtgcagatacccctgcctcctgttgatgagaagaaaaaggttgttgaagatgttgacaaggacaggaggtatgcaattgatgcatcgattgtgcgtatcatgaaaagccgcaaagtcatggcccatacccagctagttgcggaatgtgtggagcagctcagccgcatgttcaaggtacttacagtacattttctcttctctacatatttggttatggaatctagctcttgctgttgtggcgcatcatcaaattccgtatcatcattttttcctagttgctcacgtggtgttctggttgacttttcctatccatatcgatcaactacctttgcctgatgcctgataattacactctttaagttgttttattattctaccctcatcatgaaacaaaagaactgtttgcatttacccacccttgaaaaagggaaggaaaacactaggcatgtactccctctgttccaaattaattgaccttatcagcacatctagacatgttttagtgtgagccaattaattaaagttgctactgttgctgatgaagtagctcattatatataaaaatagttgtatgaccaaactacctggagtgacatagctactgtagccgtttatggttttgtagagtgcttatttgttttgatattttggttggtttggaactagcagatgtttagcctgaactgtttgtcctaacctgattttgtgcccactgcagcccgacttcaaagcaatcaagaagcggattgaggatctcatcaccagggactacctggagcgtgacaaggacaacgccaacacatacagatatctggcttgattgttatctgggggcaggttcgggggcagctggcgtgtggcgttcatgatatgctccagtgactttgctgcgatgatgcagcttactttggggatttctgtcgtgtgccagttgctaccttcctgggctggtctcattttgtacatgggggtcgttggataggagcctatcgagatactagtaggcaaatcaggatcggtggaggcaaactctttaccgcttaacgtgccttcccttgcagtgctatttatatatcttagtactcgccacttgacctagttaacttgttgccacgcttatgctttgccgtgaaaagtttctacgggcttctcttgatggcatttcctgtggttatcatgctgtggttacttgtccaccaaaattcctgtaagtttgtgctgtttgccgctctatgctctcaaggttctgctggcctgtggttcctcgagcggttccgttttagcatacatgtcagtgccttaatgcttcatgttgtagctggacggtggcgctaagtcggtgattgtgtttggctgaggaagtatcctgtcgttacagacctaggaatagcattgctgccgttctccctcctgatcgctgccctttgatactcaccatccatgaatttcctctgccgtcaagcctgcctctcgcaccttgctggatttctcacaaaatctttgtctgccccctccccaagtcctggagtgctgccatcacatgcgccaccactcctctctgccgctgtctttcttcccaatgctcctcaccctcccctctcgcccttgatgcgaccccacacatgctgcctgctagtgagcttggcagcgctgccgtggaggctgggggcgccacggccagtcctcaccaccattgaaggtctgagacgccctcgaccgctgaatctgcaagccaagttttccacgaggtggtctcctctctccgatctgccgtccgccatactctaggttgaaccggctggagcctggaggtatggtctcctctgatttctcccttcccatctttgccttttctgtaattatatggtctagcacaagctgttggactgaatgtttttagtggactgtgcgtgtaatttcgcatgttttggtctacccaagatttgagtgcatatttgtggtgatcattgattcataaaaagcttgagtgagcataaagtaaagaagataaatgtaaggcttcatcgttaatgataaaaggttgctataatttagtgtacctagactcaccgagctaatactgtcaccaaagcaaacaaaatttcagaagtagctggtactgccatttatttcattccagtatgaagtcaaggattcctagaaccacaaatatgtatgaagtcaaggattcctagaaccattagcaggtgtccaatattacctaaagacacttaatttatggcctaaaattttgagcaactttgaaccgcaaaaatactttactcttatgcaaagtatgccatttcagttctgattattgcaacatgatacatggtggtgaacttgttcatgtagcccaatcattatgccttactgaaaaacaaaacacaagtatacttggttagtttcatctctttcgcagttcttgtcgaattgagtctagctggtttcttatctttactaatatacggggataggtggtgttggtaggtaaaaaaaccgggccaaattatttcctgtcaaaaaaacctgctagatttgccttccgatctacctttagattcgaaataataaccaggaccgatcggccttcacgcgtgaaaaaacccaggacccaaaggcctttgtatgcttcgttcgtacaaacaacaacaacggtaggtgttccttttgctcgtcgttgagactttcctctcgtcgtgaaggagttggcatcgaactccgattcctaccaaatctatcgtgtcgtccaagaaaaactccaagtcgatcgctcgatcgtgtttaggtaaggttctttctcgttctataaaaaatatcagatggcaccggtattaccggctaccggaatggaaataccagccgagatttttattataaaatttaaatttatccaaaattcgtcaaaattgaatagattacaaaaatttcagtaaataccggctgttattttcttatactggtaggtatgacaaaaccggttaccgccaagatttcggaaatatcgggtgaggaaaaacactagagcacattaccggtgcatgtttaacgacatgcatattttaattgatcattttacgtcaataactcttaaatatatctacattattgaacaattagttacccgtagcaacgcactggtattgtcctagttctagtatttcctaattctgtaaatattttgagggatttgtgttggagaacacatcttcctcctgtggtgagtgagctttgttgagtttatttgcattggttggtcattgctatgaaatttgttttaggttccatgtggctgatgttccaattgttgctgggcggacaggttgaaaacatgcaacacagcggaagcacatctgccatttgcagaaaaaaggcacgtaaaatacattagtgatgacactctgttctagaatgataacataccatttgcagaaaaaaggcaggtaaaatactttgatgatcccgtttactcctgggaatgcagatgctgtttagagcattctactaatctgatgcctggacatacatctgtccggtcaaaacaaatgcattgctttggaactttgttccatacgggaaaacgagaatatcaaggtattttgtaatgtattttctgtgatcattcatagaatcattccagcgtatacggctatagcttaatatgatgaattgcatatttactgatccagcgctgctatatgattgtgaaagctctatgagtttttgattcctgattttagcctatctttactaacacagttgcctcggaacatatttggccacacagttgttttctctgaaatggtttgtatattcacttttcagtttaatttgaggatttaaagaaaacaaagcaccgtactgttttgactgttttttaaggctgcagatgtataaccatttagtacatcagcaagaacaccatgaggttgactaggtagaaaattacctaaacaccaaaacatgttccatagatcggcgcagagctcatcagaagaaatctaaattttggatcccctcgaaaaaaaaatctggaagtatacatgtccagtagtttcatcaaagctaaacttatacactgcaatgcatatctgccattagataacctgaatcttatgcaccggagagctcatttatatgtattaatccatggtcccaaagtgctgaaagagtattctactactatgtgccaccatccagtaggccctgccgtcaaaccatgtatttttttactaatgacaagttaagctagattttacattagttagttgtgtttcaatggattttacacgtaacttgatttggctctggcctaattttcagttataaaatccatatttacttctctacatcactatgtttgttttcgtagggagcttccttgacaagcaaaggcatgcttcttgcactgccgaagaaaagacaagtcatggtgtgttaattggatgatgttctgcaattggtcagtgtgttagcgtgggatatagtatgggttttaattaactgcaaataatattagttgtaggtgttcattcacttctgaaataaacaattcatcgtatttttatgaagttatctactacttgacatggttaatttataagtatttctcaaactgtgtataggtgtaatagttgctaaaatatgttgaagtggtcatcgaatatacttttttgctcctaaattcttactagaagtttataggtcattgtgacagtgacatataaacttctagctgaacattaatgaataagaggttttgattttatatttggtgttttttaatctctcaagtaactagggttattgagtaaagtagtagcaacaaattatgcatctatcaaatctatggttgcggcaaagtttttttttgaaatggagaagctattgtgagaaattgcctatgttgtatagacagaaattaacttctgatatattttctttgtagtgagtgcatattgcacagctgcgtgcttttgtcatacatcttctgcatttttctatttcattgcacttcactaattaaaaaaagacctttacatgcagccaaaacgaaaatacgcaagccaacatttggagaatgtgtaggaaaatatgcatgttttttggcaatataacaagagagaaggtgcgcagcaatgcgcgcgaggttcttctagttccaagctaatctaggtcctctgtggcctaatccttttctggcctccatgttgagtttctcagagcgcctctctacctcaacttgacaggttggccgtgaaggatggttttctaaggctggaatgaggctgatcggaaacattgcattttcctcacaggcacgtcttaaatttctaccaacttgaaattgcactttccgaaagcggtggattagattccctagcacctcaaatccagaatttgcttccatgtagaaaagaacattcctgcttaaaaaaagactgagctcgatgtagactaacggataagaccgtgtagcaaaaatgatctcatcgaatgatcaaagacatcgcctcgatcctatcaaggaaaaagtacaattctaccaaaaccgtctttgcttgagactcgttggagatatcattagtagaaataatttcttagtattgtagcaaaaccatagcaaaaaaatatagatatgtagcaaatcgccacccgccacaacaaaaattctgaaaacctgatcccgttggttgcaacatagagcattgtcataagcaactcggatcaccgttggtagcattgtcgtctgccatttatagtacatcttccagagttggtagcaacgtggtcgacaaatgtagcaccaccatcagcctacgatagcaacgctgttggcctatggtagcaccatcgctttaatgaccatcgcaaaaaaagatgaaggtcatcctcacaacatgggggcgacggtccacaaaccgtggggctcgacaagcaagcaaggtggccgccggagatcacattccctagagggtgcaccccaccgccgtcagaactcacgatcacggttgttgtagcaagaggaagccgacgacgacaaagctggatcaacaacggagaaaactaaaatcagctcgcccaacgatggccccaagctctccatgcccacgtgacacagagatggggagggtaggcgctggatgtggaggactggagagggagcgccacgacagaggcatcgtattccgatggatctccttaccggagtcgtctgcaccagcgaacgatggcgagatctggaagaaaaatgattaggaaattggggagagaaaccctcgggagtttgtatggcgagagataagagacgaggccgacaaatgtggggcccagcaccaagcgtcgcatgctcaaagaggaggttgcgggatgttccgtcccccgaagggatctaatcatattccttttcgaaaactggattagacataagaaaatattgattcagaggctatcatgagaaaaagaacaccgagtcaaaactagggatcaaagtgtttggcgcctaccatttcccatgcccttcattcgtctgtgattttctggaaaactgtgattggcacatggcaccgacgtcacttaaaattcagacattctcatttttaaaatttggatggttaggatgatagcttgaaattagcaacaatattgatgaattggcacctcttcattcattcgttcgttcgaccattcataataagcgatacatcatttacgagaagaggtgcaattttaggaggatgattgtctaaccagttacccgaatccgaattctttgccatatgagcttattgtgattgtttccaaaaagaaaagaaatcagttagaatcaagcgaggaatcccgtcttcgtgattgattgctcctactcgtgcctctatccaccgcacaatgtgggcgcacattgctagctcaaccattgcgtccctgcctgctgttacgccgcccctctacttccttcccttatcctcgtcccaaagcttaagtttgacatggccatggtagttcttcaaaatcagaggactacaatgtgccaagccctagaagacgaggtaccaacgggaacgggcctgatgtcattggatcttgcgcttggtgttgcaaggttttcttgtatctctacaagttcatgtccccccccccccccccccacaattttcaatcttgcatatgtgcttccaaattgtaagtttgtaacaaaccgatctgccttttttgtgtgaaagcacaagctagatattgcaaggtttatgtgtgttttgctattgttttgtgtttcctcggatgttttcaacgttgtgtatgtgctttcaaatgcggcaaacaagcatttggtttgttgcattagtatttttaaaatgttgcaaatatttttttgcatttctttttaacatcgtctgaatctttttgtcgtgtaatcatttcttttgttgcattaccttttttttaactattggaaaactattatgtagggttgtaacatcttcccgaagaaaatgttacgacaagtatacccacagatttgttgcattactattttataagattgtgaaaattgcttagtactatttttgtaacatcttctaagaaatattgtgttttctttgttgcaaagcacataaccgcccacatctgcctgctcgcccgatccgacgatgcgggatatgtcccgaccccttcctggacctgtttatcaccgaaaggacactaacttaacatgcattttctttcacatggtagtgagccactggaataatcaaattttctttattagagatcgatcaacactagttcacaaaaaaatcggcatcaaaattgagacgcgccgagaccactaaactaattcctctatcgctgcatccatccctaacctcccaatgagcatcgcccacgtacgaacgtgtacaagtccaagcacggccatgcactttacgctggacacaaggaatgttcactctccactccgatcgcagcttggcgggctttgatcagtcagactca

SEQ ID NO: 164 - DNA, 7992 bp, Lolium perenne
ggctgtgtgcatccgtagtgccattagggtggtgcgttgttgtagaggctgagtataattggtatcttttgatattaatatattccctttatcgaaaaaaaaactctccacaagagaacgacaagtggcgcgtggcgaagcaaccataagcggagaattttcttatgggcaacacctatcgcatgtggaagcactctcaagagcgacctctctataatgacgatttttcttgcgaattatattccttttgttgcaaaaagtattatcttgaaaaatcattgttgtaatttcaatcctctagattcctacgtctaggttggtgtcccacagcatattctcaaatcaaaatcaaaccaaagctgaaaaatgtcaaaagaatatttgcaaacccaaacctaacagtagccttgctagagccagggtctaccgagagcccaattgatcggctgtcggcatacatatgcagatgggtccaatgttgcgttgcgaaccaaaaggaatatctctttggagagaaagctatgcggacaaggccaagcccacaagcccacatatgggagtgccacagaaattattccagctttcgtctccaatctccatcgccctcccccttctctgtcgctcgctctggtttctccatgtgtggacgtgaatcgcggggagcgcgcacggcgcaccgcgtgctatatacgcgttctgcgcggagaaccatgccactcgccgaagaacccagccctctgtgctctagcgccgcgcgcttccggcgactcggcagtttggggtgcaaatgggggcggcggagctgctgtctttgtgcttggtactcgctgcggtggcatggacggaggggcagcggccccgcgcggtgaaagtgggcgcgctcttcgactacgattccaccattggccgcgcggcgcagctcgccatcgagctcgccgtcgacgacgtcaacgcggaccgctccgtgctcgcagggaccaagctggacctcatcacggcggacaccaactgcagcggttttgttggaaccgtccaaggttggttgggtttttcattgtgatttagctctcatgcttgaggaactgcagtttctttgctagctagtactaatagttgagaaagatctgacgatagttaaattcaagtaaatttgatagaggaattgattttccaggatgcaaggatgttagtatgggaagttgctaattgtcgtatttctaaactagtttagttttttttttttccgaatctgaactagtttagttggttaataggtttgcccctatgtcggcataatcatttcggaacaacaatgacaacaacaaaaaccctttaatcacaagcaagttgcataatcttgagataaaaccaaaagagtcacacaaaccaacagagcaatgatattaggataggagtaatatagtactagtgatcgtaattctaatagtacagtcaatgttagcacatggattattaattttaatcacacgtgtcaaaaatcagatctgtttgttcgataatgggcttatgcagtccgtgttaatctacgctcaggttgaatttaacatagattggggactactctcaaaacctttttgcatgcaaaaaatccttttgtgggaaaatccagttgacacggtggtatgcttttttgaaatcaagtttaaggaaaatggcaccaagccttttcactcgcacttcacatataatctcataaagggccaagactccttcatgtaagccgcggcccttaataaaagccgcttgtcatcggtctataatcagatgggctgtttgggagatacgcctcacataggctttagcaatgattttttattttgtttttttaaacggagcaatcaatttaaaattacattcattggcgctcggtggtatatgtgaccgtcagaataagcacattactggggactactcaccatatgtttgcaccatatctataattgttgttggacactaaatttcgaacagaagccaagtattatgctttcttgtcttgtgagatatggcaattaagattcagtttatcaactacagttgttgattgcttcaacagttctaatcaatgatttttttacccgcaaaaacaaacagttctgatcaatgaattttatttttgctgcagcactgcaactaatggagaaaaatgtggttgcagttgttggcccgcagtcctctgtgataggccatgtcatctcacattttgttaatgagctgcatgttccgctcctatcattcgcagccactgatccaactctttctgcatcggagtattcttactttttaaggagcactgtcagcgattacttccaaatgcgtgcgattgctagcattgcttactactatcaatggaaagaggtaactgctatatttgttgatgatgattatgggagaggtggggtgtctgcccttggtgatgcccttgcaacaaagcgtgccagaatttcatataaagcagtaattcctccagatgcgaacaaagatgtgatcagtgatatactgtttaaagttaacatgatggaatcaagggttctggttgtgcatgtcaatcctgatacagggctgcgattattttctatagctaacgagctccagatgatgaccggtggctatgtctggattgtaactgattggctagctgctgtcctggactcctcaaagtctggatatccgaagagcatgagttatatgcaaggattaattgcccttcgtcagcacattcctgattctgctgccaagaagaagttcatatcaaaatggaatattgcggctcgcaaaaggaaaattgcatctggtttgaattcgtatggtttttatgcttatgattctatttggattgttgcccatgcgattgataaatttctcaatagtgggcagcagatcaacttctctgcagatacaagattgcacgattcggatacaagcattatcactctgtcaactctcaagatatttgatggtggtgaacacttgctacagcaacttctgctcacaaactttaaaggcctaacaggtctggttcaatttgattcagaccgcaatttggtacacccagcatatgagatccttaacattggtggttctgttcctggtttgattggctattggtctaattattctggcctttctgttgctgctcctgaaactttgtatcagaagccaccaaatatgtcgtcaagtgcccaacagttgagcactatggtgtggtcaggtggctctaccactaaacccagggggtgggttttcccaaacaatggccagcctctgagaattggtgttccaaataaaccaagtttcaaggaatttgtggcaagtggcaaaggtcctgataacgtgacaggttattgcattgatatattcaatgcagcagttaaactgcttccttaccctgttccttccaaattcatatcaatcggcgatggtatacataatcctaaatatgatgacatcattaatatggttgcaaacaatgtatgctctgattctttgcccttcttcttttgtcattttccttttgatcctatggtttcaattgcaacagcattataaatatggtttccaccaatgcatgtccaaataattgctctgcttcattgatcattttttcttttaatcctctgatttccttttcttttcattgtagaccattgatgtagctgtaggcgacttcgctattatcaaaaatagaacaaggattgcagaattcacacagccctatattgagtcagggatggtgatagtagcgccagtgaaacagtcaacttcaagtgcatgggctttctttaaaccattcacattagagatgtggtgcgtaactggtgctctttttgtctttgtgggaatagttgtttggattctggaacatcggactaatgaggagttccgaggcactccacagcaacaagtccgaacaatattttggtatgttctgattgctattatagatttcttttatcatatgatcatatctagctcagaatgtaaatgcagaccacaaatattagtaatgcaaaaaaatgcttcatttttttcataatataatataatattttatcttagtgatttctctatttgttaactatatgtaacagataattcatgtttctctttcaggtttgctttctcaacaatgttctttgcacaccgtaagtctgcatcacctgatggcatgcttaactcttccattccatcttattttccattatatttaagagaaaatccatgttattttcgcatcgtgtacaaaacatcttactgtaatatcatctcaggagaaaacaccgtaagtggtcttgggcgtttcgtcctgatcatatggttatttgtggtgctgatcatcaactcaagttacactgctagtttgacgtcaatcctcacagtccagcagcttgtaaccggagttactggactggacaatttgattgcaagcactgtacccattggacacccggctggaaaatttatccgaaattatctgattgaagagctgaatattcatgaatcccgcctggtgccactgaacacgatccaggactatgcggatgcccttaaccgtggaccaaaagctggtggtgttgctgcagttattgatgaaatgccgtgtgttgagctcttcctgtcataccactgtaacttcagaatagtaggtcaggagttcacaaaggagggatggggatttgtacgtacatcatgccattatagattttcatttcgatttctcgggacatcagtctattagaggaaacaaattaacctgttcatctcttgtctttacaggcatttcagagagattctccgcttgctgcagacatgtcaacggccatccttcaactttcagagactggccagctccagagaattcacgacgagtggttgacgcggccaagttgcagctctgatgatagtgggttgggaccaagcaggctagatcttggaagcttctggggtcttttcctgctgtgtgctatgatctgcctcttctctcttggggcgttctttgtaaaaataagctgccagtacagcaggtactccagttctgtggctgctggcgaatccagtgaagcttctcctacctcccctgctgtttctgaagtacacccgacgaaaccaaagccaagacgtcttgatagcttcaaagatctgatgcattttgttgacaagaaggaggaagatgttaaaaaggaaatgaaacagagatcaagcgataaagataatcatggcgtgggatcctcagatacacactttgtctcttcagcatagaagtttccttcagacagatctccaggttctgacactgccaacacacaaaagtagataaaacagaggtatattggtagtacacgacacagctgccattctcgttgtgcctaataggccgaacagtgggagtatttgtgtctgaaccacctcctaatcagaaatgactaggattctgtctgaaaagacccttgttgggctgtatgttacgtttatgcacatgcccgtgagtagcgacccaagagcccatgtatgtttatgtatactactagtatggtttatgtactactgtatagttctggaataaatttgaataccagccacagttttgaatatcaatgaatgcattatttcggttggacggttcatatttgaaatctatgctgcagccgttgacagttcggatttaaagcataaaatgcgaatgggatgttataagttttggacttataaatatggacttgtaacctgtttaagtgcgtcctgttattttcatagttttgttgactatgggcctcttgaagtgtgttgttcctagggccggcccataggctgggcaaacaatgtgctcacactgggcccccacgaggaaggccccggccccggtactccagttctatactgtcatttgaaaatttgtgtgcgaccttggaggcgatttttctctctgatgagggttttcggtcccatgccgccgttcattctgagtctcccgtctccgctcgggctgaccaaggggatgtcctacacagctgcccagctttggcggagcggtgggatcgggttgtcggcggctggtcggttttgtgctggtgaggaagtcatggcgccgggatcgtttggcgtgaagaaagggcttgatgtgaaggatcttctccgcaagttgcatctgagtgatgtggagaaagagggagtcttcctatccaaggaggatcgtagcgatctaccggtggtgaagtggatggtcgtgggaaaactcttgtcgaggaagggtttcagtgcggaatctcttaagcggactatgttcatggcctggaacacaacacaagaagttactttcagagccattgagaagaatctcttgtcttgggactggaagcgcatcatggagaaaggtccctggcttttccgagactgtgcgttgatggttgaagagtttgatggggtgacaactgtgtcgtcggttataccaaataaagttcaagtgtggattcagatacacaagatccctcctctgtaccgaactgaaactatactaaagcagttggcatccatggtaggggaggtggacaagatggagatgaaggtggtctattttgggagtggtgagtttcacagggctcgtgtgaagcttaatgcggaaagcccgctgttgaggcttgttaatctttctcctgaagggagtgagagtttgttcatgcaagtactttttgaaagatgctaagattctgtgaccattgtggacggatggggcacagggtgctggagtgtggaattgtagaatatgaggctggcgacggagacctagcacccggagactccgcgcttgaggggtggctatgtcagggagcgagaagggactggtgcaaatcgtggcatggatggtcgcatgcaagctatgttggtggtcggtcacgctgctaatggtgggcgcggccgggcttgcagcgcacgtgattgaggtacgtcggtgtggaaagagaagtaggttgtggacccaaatgctagcggcttgagaaagagatcttctgctgaggcggggcttgcggagggagagggcactgaacttgatgatacaaccagcagccctcttatgcttgtagctgaggaggcagatgtcaaccatggaaaatacaacacgaagaagcagttgttgcttgagtcggctgtgcacgttgaggctgcggataaggaggtgccatcgctgcctgcatatgtcacaccaagggagcaaaagaagcaaaataagatagacaagggtggagttgagacaagaacacaagcgaagaatggagtaggctccgactcggggcgctgccagtttgcggtcagtagttcgggccgtaagggtagtattgtcatctattggaataataaaactaatgttaagatcttaccatattcacaatatcatatcgatgccattgtaactgataatggaggtgagccttggagactcacacgtgtgtacggggaagcacaaacccaactgcattttaagacatgggatatgctcaaatttatcaaatcggcgtgtccccatccatggatgtgtatcggtgatttcaatgagtttttacatcgatcggagcatattggtgtgcaagagcgcagtctgacgcaaattgcaggtttcgagaggtggtggatgtatgcggtctgtgtgactttggtttcacgggccgcagctggatgtatgagaagaaagtggccggcagaactttctcccgggtgaggattgactaggacttggccacggcggagtgatgctcccgctatccattggccacggtcgagaacttggtggccacatcgtcggaccacggtcccattcttctgcgttgggatccaaaacaagacacgaggctgacgagggatatgaagcgtactttcaagtatgaattaatatggaaaatcattctgattttccttctatgatggtgcagacctgtaacaacccaaaaatttcaaaacaaacaaattgaattttccctagtt

SEQ ID NO: 165 - DNA, 10757 bp, Lolium perenne
aaggtaaaccacaaggtttaaagtgcataaaagtcacacattcttatttaaatcataacttattaaatatatggaatattataaaactaaatccatttacattacgaattatagttcaaactatttgaataaaactaactatgggtattttgaaactcatatgatcatgccttggtgaaatcaaacaccaactatccaaaattgaggaataaccctcaaccttgatcttttgaccaatattataatccaatcaaatatgatataataactcatcaactataataaaaccatccacaagatatttagtagcaaatgccacttggctatcaaaaaatacatcatatgagaggataatgatctatgccacataggatgaaaatatctacatgacttgctttccaagctttgccacctcatgctcaaaggattgctatggataagggcatgacaacaaagcaccttactcatctaaccaacacaagagtcaccacctatgtgtcatgatactagagcttgcccaagcctataaatagagccacacccttcatccatttggacatcttgtaccatgctacaaggaaaccaaacacttgagaccttccatgtgaattagctaggatcaagatgaagaagctaggaggtggaggcataccacaagatgcaggtttatcagattttctgaagaacaggctacagaagataccaaggtagaattattaggcaaaccatatatttagaggatcatatcatcatgtcttaagtaggaccttaggatattccaagacattgagaagtgagagaagttataatactaatcatagccatgttcatacaagaatactagagtagtactaatattagttgtttaagacaacatttgatcttggaggtgagcaccctattccaatagccataccttaggaaaccaattctataatcatcacaacttggtaattaactataaaccctaagaatctagctgaaagtgttgagaggagtaataaagagagattagtgaagaatcagttgatcatgtctaatgcatgatcataccttgtagatatagatgataagttaaacccatatgattaatagatctcatctatcacataaaataataagtatatcactagtagttaaccccaaaccaattctcatgccttgtatggaggagaaatggcatttaacctaaaccttgtttatccaaacactagagccaaccctagcattgctttgatgcattaatcctaacaaggtgaggaggagtaaccctagctagccaataaaacataatcaaagcttatgctcatatcctaatccttggttgtgtatcaattgggtgatcacaactaaaaccctagatcacttttgcatttcaatccaagtatcactttggataataagtagaaccctgtcatgcctcatgcctattcatacttcaacaagtgaagcattaccaaaaccctaaacctttttacataggatccaatccacatgaaataatatgcctacctcgtgtatcatgtatcacaaatataaaccaagccatatatacttaggactaaatgccatttggtgagtagaatgaaaccaataccctattctactttgctatccaaataatttgcctaagtgaaccaaatgaatagtattttataaaatagcaccacctcagcaagagagttaatcatgatgagtttaggattcattttaaataattcaaacaagagtttgctaagcaagagtagtgaatatgacaaaaattcggacaataaaaacaagaaaaaatagcgagtaaaaaaatgaaaaagtgtgctagatccagatctagatctggatcgagattttaaattttagtagtggcgcacctactttttatctagtggtgcacctctcactttcagaagtggcgcaccagggagctaatagtggcgcactacgcgatgcgccactactaagccaaatagcaatgatgcatcacctggtaggccactactaacagttagcagtgatgtgatagatggtgcgccactgataggcaaaagtggcgcgccactaaatcgcctttttctagtagttatgatttaccaccaaatgctctagatgagttcctagctttatgggcactgggaacactctttgaaaaactagggacattgatatggcttttatcgcgcgctaataaggtgttgcgtatttgcattacatgtctagatcacactcttattctagctcaattggatccagatttgcattacatgcctggatcacacttgtatttgcattacctattcagataatcctattagagaatataactgcacataaagcttctaaacttgttttcttaatcaccccattagaatatgtcagcaagaaaaaatgtaaacttgtttaggcgttgtctttgagcttcaattccaagatagtcacaggtaggtgtaatatgaatagtaactttcacacaacagtacgacaaactgaaaacagttaattatgctagcacgtatggaggatcaattaagcaatttaccgtgctaaaaagggaaaaagaactgatacctcaaagatactctgcagcatatagcatgataaatcaagtgagcttaatgtagatatatccgttggaagttggagtgattctaaattctaagattaatcgggatgtgatcaaacaatgtacaaaatgacctcgtgcatattgcaaatgaatcccatccatgattgtttcttcaaaattctcaaggatttctgcccccactcagcttttcttgggtccgcccctgcatagaagtagaaccgtagaaacaccatgtggaggcaaaatcccttcatcagaggaggtaataatgtagaaaagaacagacaatccatgttgcatcatgagcatgtctatgaaactgagtttcatgttacttctcaaaagttgcaaccataatcatgaagccaccacaacctacccgatggtactccatagagctcgtggagaattacgggagaagatatggtccacgaagggaaaattgaaagcagactaatctaatcacgaagggaagattaacgggagaagatctaggccatgcctcccactatcaacctggccgataggtgaccccaaagatgctctcccaaggtcaagttaagtactggtcagttctctcaaagcagacaaagcaaatcacatatatgtgcaattaagggtttgtgaatcggtttagtcggatgttgtttgtatgctgcttccatgtaagtaccaaagaaaatttagagatagtgtctacaataagctgtccattaggctatttgtaaacaacgcaataaatcgacgtcggcggtggctaaattgccgccgcgtgactgggattcgaccggttgaacgcccggtgcctgatgggggcggcgcagcctaggtttcccgcgttggtggcgagaagggggggggggggagaggggggcgacggaatcgacgatggcaggaacgcgcacagaggatagctcgatgattggctttcacgcgtgtagcctcggtttgcgacacgctgaagtgaacacatcaaatatgccgcgctcgatagcgagttatcccgtcctgatttttttaccgcgcacacggttttacatcgcctagagcgtatccgcctcatgcataaaaatcagtttttagcgtgtggagttctttttaagcgcatctcgtaaacaaaaactacatagatgatgtaaacaacattttttggtgatgtaaattttataggcacttgattttgaagagtggacaaatggaggccgagctacatgtatatctttattttaaaattttgaaatcatatttttaagttttaaaaaaatttgaaaaaaatcctagatgtagccaatgatgaaatctacaaacatgcaaaatttaaatatgaaattcttaatactttaggctacgctaacgataaatatgtggatctgagaatagtgaatagtgcacatttcaaaactataaaacctgtcagattttgttatttttgtttagtctacaatacaaagaatttcacattgagatttttcatgttggttgatttaatcattgtctacatctagttttttttccagattttttaaaaacttaaaattatgatttccgaaattttataaaaataaagagtcacatgtgtctccgtttgcagttttccttgattttaccccttcttgctgtctcgcgtctgtcccgtacgaactctctacgaacagaggtactcggcccgattagaggagtttggtggcagcggcggcggcggcaaccttcacggcggtcggaggtagggacggcggtggtggcgggattgcacgacccgagctagttcaaccagttagttcaaaacatgttcagccttctaatccagtccgtcgagtcacctgtgcccgacgccttcgccgccctccccaccgccgacgccgacgaagtcggaaccagcagctccaccgccggcggcggcgcaaccgcatcaaatcccatctccccgcgctccagcaaccctctcccctccaccacctccgccacaacccctctcgagctgcccggcgtaccccccgccgcgtccgcacgaaaccctaagatccaccacacccgcggcgtcctccacctctaccgctcctccccctccctgcccgcttcatcctacgcctccgccgtcgccgtcgccgccaccccctcctcttcctcctccgggcccaccgccccaccgctccaatgcgactcgctgctcccggtaacaattccgcctcgatttcttactattttcctcgtttccccgctcctcatttcatgtttcttgcagtcatggcgcggcacgcgcctccttgtgctcgccgtccctacccgcgtctcgccggaggacttcgtccgcttttgcggcccctacgttgagcacgcctccgagatccgtgtcatcaggtaattttcgagcgcatacagccgttgattgcatttgattatgcgcacataccacttatctccggcgtcatggtcgtagcgacgatggggtggaggaccggtacagcgtgcttgtggagtttgaggatcaaaagagtgccgacggattctacctggacctcaatggctggaggttctcgtcctcagaggttgtaatattgccaatttggtgccagttggtttgttgatcttgtgtattactgctgctaaatatgggaagcgcgtgcttgttgttccatggtgcaggtagaggtgtgccatgttctgtttatagttgctgtgcaatacatgccatccgctgtgccaccagttggatctactgagcttccgacatgtcctgtttgcattggtgagcttattttcattccatctttgatgtttcttattcttacgcatatagacgagctagtataacatccttgagttttatgcaaagtgcgctcgatttttagttatctcttcattagcaggagcaacttcctattgtagcaatctaatatttcctccatcccaaaataagtgactcatatttgtctattttcacttgtacatacatactgaagcgcgtctagatacatgcgcatgtagacaaatccgagtcacttaatttgggacggagggagtacaaaagatcaggcacttatgacatcagaaaaagataaggcacttatgtcatcagaaataccacctctgactctgaggtacatcgaatatgtctttcctgagttttagtcccacgaaacccacagcacctcgagggaaatatcatgcatatggtttattttgttgctcttacagccaccttatggatgcaacctcttaagctactaggactacttcccatgtggatatgccatctaattctgggacagcatccatggaaataaaaaaatggtttatatatgaatctctgttgtttaaatatatccatgcacagatacatattctgtttactgggatcagtattccatctctttgccttctcaatgtttggaatttgttggccgtcgctttagttatttatcttgcacaaggtattaaatgaccaggctgctccttaccatcttttatgtgtgaaccagaaaggttggatcaagacatcagtggaattgtggcaaccaattgtgaccattctttccagtgttcatgcgtttcaatgtgggtcagttcatcttgtccggtaaggaacaatcgttttaatcaacgttccactagttcaatggggaaatcgacaatcactgtgtctcatatgaaagtaattatttcttgttgttgatttttacactgtaccgtttaccactggaactactcgttttgttagaactgtttaatgaagtagtagtggttctgcagcaatatccaatatattcatgtagtttctgagaccacatgtttgattttatttgaagacttggactccctgaaactagtagtttcaggattatttgcaggttattaaatattaaacattgtgctttgtgctcataagaataaacttcagcttggtataaataagcattgaatgttcatgacttcttggaagctgtttgaatctaattatgtaacattatttgctctcattttatttactactgtagatcataaatgtgagaatgctggtttataggcatatacgtattcattctagcactctttgttgcttgtaagtatagagttaaattaccagtttgttagccaattgggtttattcatagtttttctttactcaaaagttgtctccatttcaggtttgtcagttttgtcagaagcagtctgaaactcctacaaatcctacatgttctgtttgtcagacctctgaaaacctctggatctgtgtgatatgtggttttgttggatgcggaaggtatgttaacaccccctaactgaaactgtatctatcatgactagtatgtcaggaattaagcatgttatagctattattgtgctgtactgttgcactcgatataaatgaggatggaagaaaatctacagtagagcttaagtatatcatcacctctacttctcctggactccctaatgcatgttttttatggagtaaaagtttccttttgaccatttttacctgaactcacttacaaactagacaaaaatgtcctaggaggtcagctccattgtaatgggttcatctctatagataaacagtaactagtactacctccgttcttattaaattgacgcgatgtcaaggctaggtagtacagattgtatgtacatccagcgtcgattaaacacggacggaaggagtacaattctaacgaataacttccaaaaatcattagtgctgacacttgacaccattgccaatgctttggctccgtccttgtctgaactcgtcgtcactctgctatgtgctatgttaaagcatttaccatgtttatttaacgcagttggtagaagtttcaattaaaggaaaactacattggaggttaaataaatgagttctgcttctgtcaataatgccctgatccttccctttatttgtgcttgttatatataatataggtataaagaaggccactcaattaggcactggaaagacactcagcactgctattctcttgatttggaaactcaacgtgtttgggattatgtcggtgacagttatgttcatcgtcttaatcactcgaaaagcgatgcaaaacattctaagctcaggtcaaagtgtgaattttctggggacaacgatgacttggatatgggtggagttatgtttagcagcaaaactgatacagtaagagttttggctctctttgtgttgattctatgtaacagcatcttagtaatcttgttccttaaaatcatgtgctctgctcttctcaacagatcgtggatgaatacaaccgtcttcttgcaagccaacttgaaactcagagagaggtgcagtcctctctcctttgtactccctccgtctcatgaaacttgtctgagatttaactaaatttggatgtgtatatacatactagatggtgtctagatacatctaaattttgacaaatctaagacaactttagtaggacggagggagtgctatttttgtaccgtcactatccaacatgctgtactagagatcagcatttttttcggagttatagtttgttatacagtgggcaatgtagtatgtatctgaaccatatatatatgcctatgttcatatttgcagtattacgaggctcttctgtcagacgctaagaaagatagggaacacatttctgttgctgtggataaagctgtaaatgataagcttcaagagatgcaacttaagcttgaaaatactatgttggagaaaaagaaagttgcagaagtgagcctctttaaatcatgtatctttcagttattaatcataaccagcttgagtcttggcataactgatatctttaccttatcctgtagatgaatgaaaaactcatgaagagccaggatatatggtccaagacagtaaaaggaatagaggaaaggtatgtttgttcattccaccagaaattagtagcagctcgctacattcatgatatgtaattgtgaaagaagtcaagtaatgcaaattttttggggcgcatcatggaaacagatacttgcagtgatttggctaactgcataaatacgtatcatgtaacagtctcatatttaggatgttaaagtaacatttcgtatgaattccattcgaaaatagcacaagattcatgtatcgtttctgataaatctgcacgcacagggagagagcgcagttgaggctgaaggatgatacaattcttgacctggaagaacaggtgcttataatatttattattgtttattgtaaaagttccaccttagagaggagtttcagtacaggggcttttctaaacattccatgtgcaattccctgcagattaaagacttcaagtactcgattaagttgcaaaaatcgatagagaagagtacacatgctgatgatctcaaaggaggtatgctggtgccactggccatggaatcagaatctggaaagggtaaaagatcgtcaagaagcaagaggaggaattagcggcagccatgcaactggcctctttgttaactagcaagacagttgctaaaaaaaatgaactagcaagacaggtgtgactttgtgggagaagcctccttactgttagtttctcactgctacactctgatacattgtccataacgaaactacaatcgggatactacataacatttaaaaaaatacagaatttggacattgtgtagaaaatataaccaaaccaaatccaaagttcgtattacatacccagtgaagtgtcaggaagttgtatcaatgtataagcacacattagtttacaatctgataaacacttcgaaggtgcagagtttgagcattatgtcaacatgtgtaaaaaaggtaagcaaactatccatagtctacattacatacccagagtggaatttcagaaatccaagtggacatagacttaaacattgagtacatacatgactggcagttttttcttgggacagattacagcctgagcatggcaaaacgagaacccaacggtggcccaaacccaaaatggcaacacaaacgcagcagccctgatcaccatgcgtttctcctgcttcttcctccaccacaggatctggagcgggagcagcacacatgttgccttgtgtaatcttgtgaaggtttgtgttaggtagctctccatgctgaaagacctgatgatagctgggttaactaccaaggtatcggtccactcaactcattatgggagaggtccaagctttctatctcctccatgacgccaaaggtagtagggattgtgccaacaaagaaattgttggacaggtggatttgacatggctcagatttccaagctcccaaggaatttttccatccagcatgtttgcggatagattgatgccagacatcgaaacgaaaaaactgcaacagtgtgtagaggttccttttcgtagcaaagctgaagccgcttaagccatagaatgtacggtagcagtcaaagaaaaatctcatcgactgcctgaataatttctatcatatgcggcacctatgaaagatatattactcctaccaatacatgctggtaacgaacttgagagcctgttatgagacgagtcaattatcctcaagtacaggagtttgcacaggtttggacccaatgaaagtagcctaatattgtcaagataatgtacccaatggaggttgcctgtgaactgattgtgagtaatatccaaagcaatcagactggatgcattaggaatgagaaagatatgtcgccagataaggaattcccagaaaaattaacataattgagcagcacaaaactacaatgtggtaaagatcctataaggttgttgcttgatatatctagaagtcaaagacttgtcaagccgcaaatttctggatgaactttccctgttatacggttgccagcaaggttcagtaccagcaaacaagacatattccacaacgagttatcaagtttgccagaaagctcattatcatgcaaatcgatgacctttaaattctcttctgatagatcatgaggcaccataccaaaaaaatttattaccatctaggaaaaactctgactcaatggaaaaattactcatcccaccaaaaaccacaccaccaagcttgttgtttgataccctcaaggtcaagagcatgggataattagtaaaaacacagggcggaatttctccagaaagttcattgtttgataggtctaatagccccacgattcccccaaaaaactgtattcaaata

SEQ ID NO: 166 - DNA, 33436 bp, Lolium perenne; identical to SEQ ID NO: 162

SEQ ID NO: 167 - DNA, 1218 bp, Lolium perenne
gatgccgagtagcaagctggggtttgttgagttcttccagaagtgcgtgcctgcctgcctctcgtttgtgcgtrcttgatcttgaccacattctgctgggtcctggacagtcaagtagaaacaatgggaccggcgtctacacgcgcggcagcggcactcgatgacgtgactttagacaacaccgacgccctcgactgccgcctttgctgcctaccactcaagccgcccatcttccaggtaattaacatatgcaaaatgatgtcaaccatgcgaacaagggctcatcgtctcatgtctccgcgcttgcagtgtaaggtggggcacgtggtatgctcgacgtgccgagacaagctgggggcggctcggaggtgccatgtgtgtcgcacggcgacttccggcggataccaccggaaccacgacatggagaagctgctggagtccatccgggtgccttgctccaacgccgcctacggctgcgccgccaagccggtctactatgacagggacacccacctccggttgttctgccagcacgcgccctgccactgcaatatagaagcatgtggcttcgttggctcgacattatcggcgctccttgaccacgtcttcgccgtgcatgttgaataaaccttatgcatcagttagttcactttacagttatagctgtagttaggcatctgttagtcgtggtgtttgagccagtcatgggatggcatgacatgcggatcaagaccgttgtaataggtgcctgtagatcacgttcggcacgatcgtctcgtgggatcgcgcgagtgtggttgctggtcgcgtggagcgtttttagctgagattgttacacctctgtatctctgaataaatagagaaaaaaaaccgaaaatgcagtaagttttacactgcgccaaactgtgtctcccctgtgtgtttttatccacttgtatttgttcttcacgtgttcttcgcgagatcgtgcgagagagtcttggtatacccgaggatcaggacaacagttggtatcagagcccgtgtgctcgatcgctgaggcaatgtccgaatccccgacgaagaagtccggcgaggcgacgccgcgcgccaagatctccgatggctcggaggaaggtggaggccagatcgtgatccagtggatggttagggacggtggatcggccaagtggccgatgctcaccagaaccaactatgccgactgggcactactgatgc

SEQ ID NO: 168 - DNA, 25138 bp, Lolium perenne
  misc_feature (455)..(455): n is a, c, g, or t
  misc_feature (809)..(809): n is a, c, g, or t
  misc_feature (1163)..(1163): n is a, c, g, or t
  misc_feature (2078)..(2078): n is a, c, g, or t
  misc_feature (2273)..(2273): n is a, c, g, or t
  misc_feature (2298)..(2298): n is a, c, g, or t
  misc_feature (2302)..(2302): n is a, c, g, or t
  misc_feature (2304)..(2304): n is a, c, g, or t
  misc_feature (2309)..(2309): n is a, c, g, or t
  misc_feature (2320)..(2320): n is a, c, g, or t
  misc_feature (4935)..(4935): n is a, c, g, or t
  misc_feature (5969)..(5969): n is a, c, g, or t
  misc_feature (6710)..(6710): n is a, c, g, or t
  misc_feature (6717)..(6717): n is a, c, g, or t
  misc_feature (6773)..(6773): n is a, c, g, or t
  misc_feature (8223)..(8223): n is a, c, g, or t
  misc_feature (9104)..(9104): n is a, c, g, or t
  misc_feature (9106)..(9106): n is a, c, g, or t
  misc_feature (9953)..(9953): n is a, c, g, or t
  misc_feature (10303)..(10303): n is a, c, g, or t
  misc_feature (10450)..(10450): n is a, c, g, or t
  misc_feature (11003)..(11003): n is a, c, g, or t
  misc_feature (11014)..(11014): n is a, c, g, or t
  misc_feature (12046)..(12046): n is a, c, g, or t
  misc_feature (12481)..(12481): n is a, c, g, or t
  misc_feature (12585)..(12585): n is a, c, g, or t
  misc_feature (12602)..(12603): n is a, c, g, or t
  misc_feature (12606)..(12606): n is a, c, g, or t
  misc_feature (12626)..(12626): n is a, c, g, or t
  misc_feature (12701)..(12701): n is a, c, g, or t
  misc_feature (13258)..(13258): n is a, c, g, or t
  misc_feature (13407)..(13407): n is a, c, g, or t
  misc_feature (14495)..(14495): n is a, c, g, or t
  misc_feature (14583)..(14583): n is a, c, g, or t
  misc_feature (14711)..(14711): n is a, c, g, or t
  misc_feature (15017)..(15017): n is a, c, g, or t
  misc_feature (15412)..(15412): n is a, c, g, or t
  misc_feature (16456)..(16456): n is a, c, g, or t
  misc_feature (16503)..(16503): n is a, c, g, or t
  misc_feature (17557)..(17557): n is a, c, g, or t
  misc_feature (17623)..(17623): n is a, c, g, or t
  misc_feature (18210)..(18210): n is a, c, g, or t
  misc_feature (18366)..(18366): n is a, c, g, or t
  misc_feature (18771)..(18771): n is a, c, g, or t
  misc_feature (19059)..(19059): n is a, c, g, or t
  misc_feature (20417)..(20417): n is a, c, g, or t
  misc_feature (20788)..(20788): n is a, c, g, or t
  misc_feature (20831)..(20831): n is a, c, g, or t
  misc_feature (20856)..(20856): n is a, c, g, or t
  misc_feature (21110)..(21110): n is a, c, g, or t
  misc_feature (21297)..(21297): n is a, c, g, or t
  misc_feature (21439)..(21439): n is a, c, g, or t
  misc_feature (22274)..(22274): n is a, c, g, or t
  misc_feature (22374)..(22374): n is a, c, g, or t
  misc_feature (22484)..(22484): n is a, c, g, or t
  misc_feature (22495)..(22495): n is a, c, g, or t
  misc_feature (22554)..(22554): n is a, c, g, or t
  misc_feature (22579)..(22579): n is a, c, g, or t
  misc_feature (22599)..(22599): n is a, c, g, or t
  misc_feature (22609)..(22609): n is a, c, g, or t
  misc_feature (22614)..(22614): n is a, c, g, or t
  misc_feature (22623)..(22623): n is a, c, g, or t
  misc_feature (22913)..(22913): n is a, c, g, or t
  misc_feature (22990)..(22990): n is a, c, g, or t
  misc_feature (23435)..(23435): n is a, c, g, or t
  misc_feature (23476)..(23476): n is a, c, g, or t
  misc_feature (23551)..(23551): n is a, c, g, or t
  misc_feature (23592)..(23592): n is a, c, g, or t
  misc_feature (23701)..(23701): n is a, c, g, or t
  misc_feature (23771)..(23771): n is a, c, g, or t
  misc_feature (24316)..(24316): n is a, c, g, or t
  misc_feature (24563)..(24563): n is a, c, g, or t
  misc_feature (24949)..(24949): n is a, c, g, or t
  misc_feature (25113)..(25113): n is a, c, g, or t
aacggttgtatcaagagatgggatgtcctcatcacttttcctacctcactagcgataaagtgaatgcatgtgctatgttcgtcacgtgataaaagtgatgatcttgtttggtcaaggtagcatatttgatattcaaacattatgtcaaagtacatatggatatactttgttaattctttatacacaattgcatggagttttccctttcttgtggagtataagagagatatgttgcatcatctctatgttaggacgtgatgcccatatgaatgcgtatcttactcttttttttcgcatcctcatatcttattggtgaattactatttgtccactaaaacttaaaagagagaatattcaagtgaactcatgaaccccggtccactttttatcataagaaaaatctttataatgcttttatcttattttctattttctgcactattttaatccaaaantacaaaaatatttatttttcttatttgcatccaaaacaccaaaaataatcaacccctttacatttttacttaattactttatttcatctagttttactcgctttatttttacttgtgttttattttcttacgcgaaaccttgtgcttgataaccatgcagtgaagttagggacacaaggcttttattttacttgcaggattgctagaagaagagagaagagaataatctttgctcagtttcccgagagttcgatttaaaccctcgaatcacccttttggggaaaatacttagctgacacaacactctacacttggaatcccaacgtatcaagatctttttagcgtttttttttngacactcaagaccgtgaggcaaaaatccccacaataatttattactccaaattatgcgaacttatatacacaaaagcaaatatgtacaaaagctagagaaagataaaaaagaataaggctctaaggcagagacctaatccaagagagcaacctatccttatgcttaactttgatcctatactgcatccaagaaatctttttggcgttgttgcaggggagtaatcaagacacttaatcaagcccatcgactattatcactttcttaattttgtatcttcagtctatttgcattcatgttgcattgacacttttatatatgcatgattgcctattagagttagctttggaatattncaaaaggtagaattgatcattgatgaaatcatgtgttgcatatcttggttaaaaatttctctgcgtatttagatgctgggctaatgtttgaggtccttagtggattttcggagaagaatgagtggtttttgaagttacagagagtttagcgggcaccagtacgggagcatctacccgtaccacctgcctgtaccgctcctacaatgcaacgaagaaactaatttttttccagaaaagtcactgtgaggatagcgaccgtcggtacggcgggatgcgcccgtaccaacctcgccaccagacgcagaaaatttgaagaatttccagagaaaatagtgatcgtcagtacgagcgctttagtaacaagcagtccgccgagacgctccccaaaaaccttatcgcccgcctcccggtgcaggatctcaacagacagggttttagaggcctactctcctggacggtcgtgcacacagtcaccgggatgaggaaggctagagagtagcacaacaaaataaacttcttgagagagagacaaacaaagcagagagttaagcatcagatccgttctgtctcctggccggtataggctgggaggagagccgaccgacctcgttgccacccgtaggaagtcatggacacgaggcgagcatgcagatccgttctgtcttctggtatagcttgggaggagagccgaccgaccgcatggctggcgagcatgcacacgcatgatcgacatgtaaccaagcaaaaaatttaggcttccacagaaggtgtgtcaaactcaaactcgagtcacgaaacgtgacacgcgtgcgatgcgtggcgagacgggtgacagaagaggaggaggagtgcgcgagagctccttctcttgtcactcacttgaaaggactagaagagcagcccttataaaccatnccaactctaacaatgtgggactaaactttgtcccaaagactatctcaaagctaccaacttgatggagcttgagatttcagaaattgtaggcaatatggactatcttagtggactgtagcccatctacatccaacaccttttttttttcagatcacccgacctgattaataaagctcctttttacccgaaaaaatnccagcggtttctttacgtttacgancagntnaaaangaaacagaaantccgaaacaaatttagagaaaacaattgggtccttcgtctccgcttcgacgcctgctccggagggttgagcgaaaatgatgaagcgtcgaatggttggtgcaaagcgttttccagcaggtgctgggggctatccgatcattccacgtgcctgtcatctgctcggcgtctttcctgattttcctcccctcgctcgcactcctcccaggccctcgccgcctcacctcagggcccactccatctttgccgccaccctcgccctctttacgcctgacgcgtctcgcgttacttgacctcggattcgcctattcaccagatgcgtcctgttgttctctgatcccatctaggaaatcttcctgctcgagcgataggtccgtacttcgctctctatctctctaattgccaaaatgatttcgtgatgtttggtgtcgtattcctttgttccaacttgactgaaccttcacatttctttttcgctttttgagataggagctatccaagtttcccatggttagtgccgagtttttgtgaacgactgtgccgaaagttctgtactgaaaatcaaccagattatcttttatttccgcatgtctcagtggaagctattctagttttgattaaggacagtttatcaaaatgaaagctagcattttaaagcaaaatggcaatccatatcttgagctaaatgtctacagactacagtaccagtcgatttcaggacaattttctctgttggaaaggtcggcatatagaaaaaccatatcatagacactatttcactatttttaaaacagtaaccaccgaggtttcttcagtttagcgaacaaacaattccctgtaatagtttgaaataatactaatcgcaaaagataaatttctcaaaccatcagttcatagtgcattctggttcattctcgaatttttttagtgcattctggttgaataatgctcatttgcctttaagagtaacgtatgaacactagtattactagaataatactagtacgttacctgaacttgcactacgaatctttcttgtgtttatcgaactaggagagttatccttcctcttacgctgtattgcttggcatactccataaattccctttataggctaataactggcatgtttataggcaaggatgtctcaaattcgtaaggatacaaagaaaacagtggacatgaatgcgctggcgagctccatgaggtgtgaacttgattattactggtcactgggtgaagtctctgacaatgggggagtttcatgtgtcatctacaaagtccaagaacacattcgcatggctgacaagctctcttacgaaccttgtgtgctatcaattggcccttatcatcatggagctccagccctacagaccttgcagaaagacaaatggagctatttagattttattctgaacttgaatacagataaaaccttgcaggattacctacttgcacttgaaagcctatcaaaggtagcaaggagctgctactcggaggatatcgaaatggacgctgaggagttcctgcaaatgcttttactcgatgggtgctttgttttagtagctcttggaggaaccaaagaaattttggcagccgcaaaacatataaagttggacaaattgaagtctgaagatacgccagagaacatatctaatcccaacgatgcttttaatgggacagatgaaacaaataacgaaagtatgaaccaagaaggtggagaagatggtaaattgcaggcagaacaccgcactcaataccaagatgaattcgggcaatggttctatagatttttagttcatgatttgttcttgttagagaaccaaataccattctttattgtgaagaagatattcaatgtagtcgccagtgacaacatcttggatgattcaccgtttactcatgaaatatcgagatatgtggacgctgctttgcggtggtttccaaaatcaattcaagagtctgatatgccgaaagacttcgacaatttacttcagctgtgccacatgtactttcggccaagccgtacggcagaggattatagctatcaattaggaaagcaatatttcaacagatttttaagtttcggcctcaaatacttgaaaattggacagtatcatgacgatactgaagaatattcatcatacaatcttgagataccatacttacaagatggccagcagttgagtcgctggcgtcgagctgcacaataccttgaagctggagtcaagtttaagaaacgggagcatgatcaattgcatcctcattcactattagacgtaaaatttagcaatggtacaatggaagttccatgtattgttcttgatgagttcacgggggctctctttaggaaccttattgcatttgaacaaacttgtcctcagtttggagatgactttacagcatacattgttttcttatcccagctcataagtatgcctgaagatgtcacactacttgctcggagagagatcattgtgcatcatctcgacagcgacgaaacggtgtcagatctgttcaccatgctcagtaaggatgtggtctttgattttaatggtcagtattatctgaaatctttatgccagatgatggagacttactaccagagtcgtctgantaggtggatggcatggctttggctaaatcacttcagaaacccatggttggttttagctgcatttgccacagctgttgttctcgtatgtacagtagtacagacagtttatggagtactggcctacattcacccaccaggatccaacaagtaaagtatgttaagcatggccaaggccaggcagccaacatatgtaacatgcgactaattgttggtatttagctcttctgtgtgccaagcttcagcaacaatttccatatccctgcttccgttttcctttttcagaatgtaggagctagtcgctaccaatttcacagtcgacagacagaagagcaacaattgacatggttatggttatggcatgaatagcattgaatattgatgattcactggagtttctgaagctctagaaaaatgcagacttaaacctacatggcctacttttcacaagatggcgcgcatctgtcgatagcaatggatctacatttattttctcaagttttgaaccttggagtcatttactactttaatacgtgcaacagcatatattgttggtttaagctctccttgcatgacagacgacaaagcggaaactgggctgagctctgaataagatcgtagcatagacaggtacggaggtaccagtggcagaaatcacataaacgttacagtcatgtatctcgggctctttatgtatctgatgtatttttgagttcttggcacaatatttattgctcaagaaattttgttgttacggcggtacacatgcttgaatcagatgtgctgatagtattgttgcaaatgctgatacgtaaccgtgtttctaataacttctgtggtgtgtactcacttatcctgaacctaatcggatgcctcgttggatcgaatgtcgtactgaattggtgaagttaccccctgatgccgggggaaatcctaggtccggttcaccggactaggcggcagccccgccaatgtattgttatcttcttagggcatctacaatggagacgcttatcaacgagcgctaggattttttncccagtcggtcggcagttttgacgtacgatcccggctgcagacgcttatctaccggcgtcgctgcaaaaacctgcgccggacgcttcctttgattttccttgcagcatgaaaagcagccgcggttgttataccaaaattagagggcagcggataacgcgggcgataggattagtcgatcaattcctctccgctcaagcgtttatgtaggcgtccggcattgaacatgcccttaaagacattgtctaggccattagggagggaccgatgcggctttcgaagtctgggggtggtcttgaagtcgaggttgagctttggtgttgtcttgcttgttttgtaacgcggttttgaagccatatgcttctcttctcaccattctagtaaaatgttggtcaacaagagttgtttaccattgggtgtgttgtttgccatttgacgttgtaccgtggagagaagttgttgccttcttagcgttgtatcagctatcttaatctatcttctgattgataaatggtacagttatcactcactacagttactacatttgcgagatcctgatcgcagattcgtgtgaacttcatgcatgatctcgtggtgcacgcgaccaccagaatccagaaccgcctcccccgacccagatcgacccatagaccatagcatggctctgactccatgacccataccatccatctccaccgccgccaccgtctggactctggacaccaccaccccacctcactacntcacccngcgccgcctgctgccgctgtccccaccgcctcagccgccactccaccgccggcccntccctctccgatgaccagcccatccgcgccgccgccctgccctcacctcgccgcgcaccgcctcacctcgcgcccgctccgcttcccccgccgctgcctgcgcgtgcgtccgctcggccgccccgagatccgccgcgacgcgcgcgaggtgccccgctgctccccctgcgcgtcctcctccccgccccccgcccgcctctacgcctgcctctcctgcgcctccgtcttctgcccctcgcacgccgcctcccacgcctcctcctccccgggccaccagatcgcggtcgacgtggaccgcgccgagctcttctgcgccgcctgcggggaccaggtctacgacccggacttcgaccacgccgtcgtcctcgcccagtccaccgcgctcagccccccatccacctccaccccctcacccgctccccgcaagcgccgccgcgtcgactaccgcgcctgggcgccagatccggccgaatccgcgctggtcagcgcggccgccgatcccaccacttcagcgtccacaaccgatccagcgggcctgcgcgggctaaacaacctcggcaacacctgcttcatgaactccgtgctccaggcgctcctccacgcgccgccgctccggaactacttcctcggcgatcgccacaaccgattcctctgcccgcgccgcacgcccatgaggcaccgcgcgaccgatgcggacgccaaggccgcctgcctcgcctgcgatctcgacgagatctactcggccaccttctctggggagcgtacgccatacagccccgccaagttcctctataggtccggatctcaagctctatttgcattggttcatgtcgcgctgtcatttcagcagcctgctgttctattttatgctgggttcgttgcgtattagggtagttagccgaccttagttaaatgcctgtgtcaagtattgtaactgtgggcagcaggtcttgtttgagacagtatactgtatattctctcctgcaaaagatagtggaactgtttaaagttagatcatacagattgcaagtgtacttagcatgatatggaatgatgtgaacagagatatatcactaaaaggggcaggatctgcttagtgggagttgcgctactgggggaaatggttgcatgttcctgtttgaagaaatcccattgtactgtatatagagcatgtagtgtgaagttcttatgttttcatttgattctgcaagtactcttggcatgcctacctaaatgttcgttggactttgattattgatcaagtgacaaaatgcatgagcacctattaaatcctttcaagtcagctgtttgagaggtccatgtgaaagtaccactagcatttgctctgttctttgattctgttgaatttgcctccattaactctatattttgagtcatttattgggtaaccaatttcagttttgtgctacaacagtatgtcttgctactnccaagttagtatgcaagtatgtagcatctgtagtggtactcacaacgtctcttatgtttctttgtcatggcctatcaaaagtctcttttgtctcttgttacctactgttcatgcatttgctactcacaacttgcttgttttaaaaatgtcatatggctattttaaaactgttgtcatcgtagcgagaaatagtgcagcccagacattttcttaagcaataatgtttaaactgcacttcattcttctgttttatgaatggaagtacttgattttcttctgattttttatcgttatgaattgttagctggtggcagcatgcaacaaaccttgcaagctacgagcaacaggatgcacatgaattttttatctccatccttgaccatattcatgaaaatataaaggatgatgagcacaaatcacatgaacaaggtagttagcttctctctttctacttttcgaactaaagacttgcatgtactgcaataagttcagatatgaactaaacagtaaatgttttgcaaaattattcttcaggatattcagatattgtgtatacgtcgaatgccatgattggggacatcctttctgttcagttcttccagatccatctcttacgagataatttgtggctcctgaaattttgttctacttgtttgtcctactattcttaggacaggcaaacaagtgaagtgtgaaaaaataatcatcttcctgcatttcatcttttactggtctgggttttgatatgctgggcaatgattgaccgtgaacagttgtcatttagtttacttatcttgctctttatatgctggactgcaatttgtctttgcaaatatgttctgttaatgttcttggttttaacctttatttctatttttttngnctcataataggccacggagactgttgcattgcacaccgggtgttttctggtatcctgagatcagatgtcatctgcacaaattgtgggttctcatccacaacttttgaaccttgcatggacttctctttagacttggatgctggatgtaacggttctcgtggtgttgcaaacccaaaagcacgcaatggagagaggaacttagctggcatgaatcccaaggtatcatcaacactcatgagatgtttggagcggtttaccagggctgagaggctagatgctgaccagaagttcttctgtgaacgttgcaaggagaggcaagagtcccttaagcaaatgtccattcggaggcttccactagtttcctgctttcacatcaagagatttgagcattcgacagttaagaagatgtcaaggaaggttgatcactctttgcagttccctttttctcttgacatggcaccttacctgtcatcctcaattctcagaagcagatatgggaaccgcatatttccatcagaatccatagattcagaagcagtttcggaattgtcttcagaatttgaaatatttgcggtgatcactcatagtggtaagctagatgctggccactacgtgacttatctcaggttaaacaatcagtggtacagatgcgatgatgcatgggtaaccagagttgacgagcatactgtcaggacttcccaagcatatatgctcttctatgtgcagaagacactttactataaagcttgtgaaaagccagctgcagtctgaatgattttgaacaaatattgagggccttattctgtaccagcaggaaatacagccatcatctgatagaacatagttncgcccagagaaaaatgcctgctgttttcatatcattgccagcaaggtggacggtcaagttttgtgttctcattgaccatagaatcaatcagagttttttttttggtgattttcaacagccagcaacccaaaaggaaagatggtcacatatatatgttggattgtcttgttatcctgataatggatatcttgggggcgtgaactgaaagcacttcattatttgacaccattggtggtgatgttctgaccaatcttactggatgtaacattgatttgcgcaagcaaagagtggagtatgtagaagtgggacaaaagggaacctaatttttgatgtgttccttggtaattgantgccatctctcttggagctagagttttatattgctgacacctgtaggtcagtctgccttttgtctctccctcatttgatttgttcttgcttgtacttcatagaggaaataaagaaatatagctgatgagatgaaatagctttttttngcatcctttttctttcgccggctgttctgttattttttattgacatggctgtcagtgtttttttgttttccttcaactgtacattccctggttgagtaactgtagatacggatcttcatagaattgctcgacgagatcttatattctttgaagtgcagtaggtgttgcagacttatttgcaagtttcagattagtcaggtcagtgtcttctatatcctagttgctgggcatgtgaaggtgcctgagtcagtgacaagctgatcacgcgtgttgaagatccgtcggcctgttggctgttgttctcaatgaacggcatccattcaaagatgcaagcctgtcaaaattgccgtcattttcagcattgaggggtaaggttgtttctccaggagtctggaagagagagcaacatgcggattcctttatatccgctttactgggaagaacacctgtaactgaaaggaaaaggctcaggatcagatccgatcaattcctatgggctatgagttgtgacgataagatcctgaaaacaaaaaggaaacactttttttttgtncaaaaaaaaangggaacacaaagtggcgatgcattattagcttatcaggtacttggaagattatctaatcgagtttctgtgcttatttgacctgataataatttaactacgaagcgtgagggaatgatcaaatggcgacccttttctgaaactggaaggaacagataacacactgtacgcgtgccactttccaccacaccttcgctggtctgcccgcgtgcagtggccagtagctactgtgctaagtttgcttaccaagctttcgtacattttctggacaaaatgcgtacctgaaccggggccagcctatcagcatcggctccagcaattgcaagttgcttccagaatgaaaagttttgcccagatctcacccccaaccagcacgtacaaccatcattttctaaataaacagaagcaggcacatcaccgacgacctgctagttgctgcttatcagctgcattccttgactgtatccgcgtgcatttctgccttgtgtgcacgctgaacgtgtgctcgcagctctcaaagtccacactagcactcacatttcacgctagtcctactctcctaccagtcggcagttgttgacgcttcataatcgaagagaaggacttgacgatataactgcatatcttgtcatttatcttcgattgggtactgaacacatgatatattcatgtaacgctgacaagcccatcgtaccagaatcgtcttgcaattatatcactgaacaaactgggcacgaggtcggcatccatatggagagcactggcgaggccatgttgctgtcgaatgctttgatcgatggaagcatatatacacgttggtctaatgaagtaaaggaggagtataagtgagcaaaccgtcctattcaagctacaggttagctatagctaaggcgcacgtaactaatgctgtagaaggcacgtcatggtccaccaaattatataacaagataacaaagataacaaactttgtctcgcccaatgatccgccaggtttagcttcttttgagattttctattgttattactttccgaancgaagattgtcttttgttatgcttcagcaggcctagctatgccatgagtttgttttgcagtagctatatcaagcaggagagcagtctgagaaaagtgttgaaatcattggcctagcaccaatatgtattaacaatagtttgtgctgaaaatctcaaaaccccatttgcctcattcatgtgtggcaagaggtgagactaaagtttagtgtgacatgttagtttataaggagtttgagctccatataaggaaagctcttttccatgttgtattaggcatgcgaaaagaagacctacacgtgctcctccgctgctcacccgatcctcacgacgcacgtcggctttcgagaatgtgtggggctgaggaaccacctatacaccgtgtacgagttgtctttcccttcaccacacatgttggagaatctgaaaagttttttnaaaaccaaagttgcatcaacatacaccgaaggagggatagtaggcctctagagcctcggctgttgtagatctatacgggtgaggggtgatcagattttaagggnagggggggggggggggnncgnagcaggggctacgccccccntatgatccaggctttcttcacaaaattagccatgattgcttcttatctatgttgttttagctagcttagcccccntaatgcacaacgtagtattagctcagcccaccttgagctaagatcctggctccgtcccagctaacacggctactggcaaacaccacgtcagaggagaactccttccccgacaatggcttctttctggatgtcaacaacctcttcggcgaacatgaatgcgcaggttgtaccatatgtgatcatgtcctctctatttgagattttggtagagtttacttgatgtagcaattacattaaacgtgactatcatggtaatattttcatcttctattttctcgaataaatatgtacatggcaatttgcttatatattcaaacacaaagatagaaaaaacttgggactattgctcacctttgcaagtcttggaattaaaggtcgttcaactaaattcacactcactcaagccgttacggttctcaagctccatcaaatgcatgctgaatcgttcaacatccgtcccgtatctccgtggaagacaaaatcgccattagcgtgatccaccaagctatcgattgctaccaagttgaccaacaccattgaccttgtgttactaaaancacacaaacaatcatttactactgtggtaacgtaatggcagcagcctaacccgaaccctttttcaacaccgtgaccaggacgtctggcaccaccatgccactcaacgcactcttcccctgatcacaattcccatcgcgtgacacagctnccaccccgcaaacgggccggcacggtactctaccctccggggtaacctctcttatccctacgcacgcgcgcaccgccacggccaaagaatcccagtagcgatcgatcgaggccccggccgcgtccgcccggacagcaacccgccgctccgtatcccgacccacaccgccaccgcgcgccaccctgcctcgccgcggccacgccaaatactcctcccacgcgcgcgcgcgccacctctcagtccgtcgagtcgaagcccccgaagaactcgccggacagcgccgcctcgtctcctcctcgtcgtcaagaccgcaatagaaacttccgctggtaggtccggtcgccccggcttcaactccacccaccaccaccggaatcctccgccccccaaaccgttctcctccactcctcccgcgccctcgctctttccgtgggcgggcgacggggcggagctcacccaccgagtccaccgcaagcatgtgctgaggcgccgcgccactgcgcgactccacccctctcccctccgcgcggttaaattgctcgcctttcacactgctcctgctcctcccgcgctttgagagcacaacgtccgacggggtatgggttccagcctcaagtaccgcgccgggctcgtcctcatcggcgccgtcgtgctcatatgggtcacctccgccgaggtcacgcaggtacacgaaagactcagcctcccctcccccccactcttcttcccctgcctcgttcccttctgttttaattgttgtttrtttattggagacctgggattcttgtcttgccttgagatattccttgcttaaattaccwgccgattaatctgatggttattttaaagtaacgcttttttctgggcttttgttccgccgcctgaatagtttcaactaaaaatgctcatgccttgtttgttctgtatggaaaaaggattcagggtgatatatatatggacacgctttttctgtgccatttgttccgcgtctgaatagttcaatatatcatgcgcatgcttgttgtctgtagtggaaaagtgatcaggggaatattatggcagcatgtaggatttggcccaattactcntttcctgttccatcccaatttcgtggtcttgccataaagtggaaatctgcatatgtgtggaattgtattgttgcatactgttttttgnaaagaaataaaagttgctatcgttgtgcatctgtcatcactcatcagttagttacggcaagtgtgcatcgccaatacacgcctggctgattctaggtggttgcgatattattcttgctctcacctaantcatgattgtatactagatggggaaccttactttactgttggcaatcggtatgttttcaatttatatgacctgcccacgtttcaaagctctagtctccaaggaacaaggaactacttacatttggctgaaaagcattatctgttcaccaggataacatatgctttttaattgtacaattttttttgttcctttcaaaagagttctgttgtcaaatgaatcaaatttcagcttcagtatctgaactgaacttatgtgcgcaggagatattcgctgactacaagcaaccgttcgcgatcacttacttnggggcctcccttatggtcatctacattcccttggcgtttctgaaggatttcatatacaaattgttgagaaggcattctggaagcagcagagcgtcaaaagtcgtgagcaaatcttcctttggcggcagcgctcctctgaagaatggtgaatttgagaagatgctggaaatggaaccgcagaaaaccgtggtcatagattttactgatgtggacatccctgtgctagaagaggcaaaaccgcttatttgtggaatcggtgagtttggtgatgatgttctgaaggagcaacagctttccaccaaggagattgcaatttacggattatatctttgccccatttggtttgtcacagaggtaactttccaattatctgcctgtttgatctattgagtagntttttttttttgggtttttaatcataccgacagtagcttgatcgatacagttgctcatcttcccttatgctcttatatggatgcagtatttatcaaatgcagcccttgcaagaacaagtgttgccagtactacggtactatcttcaacttcgggactcttcacactcttcattagtgtgctccttggccaagattccataaatgctgccaaagttattgctgtttttgttagcatggctggtgtagcaatgacaactatgggccagacttgggcaacagatgaatctgaagtaagcaattcagggtgagtgggtttactcaggcaattaagcttctcagctgtgcgttgatggtgccaactgccaagtgacctgtatattgtcccaacttaatttgatgttcttatgaagccatgtacttgtttgctttgctgtaagatggttagctgtaatcaatttattttttattataaaggagaaatgaaaaacaatttgcattcctatgtcctgggaaaattgatgagatttttttaatcagcttgtaattttggggcagaacttatcgccttgctaaccatctaattcttaagccttactactgcagggccacacagaggactcttctaggtgatatgtttggtcttctgtcagctgtgtcatatggtctcttcactggtaggttgttgcacttctctgttcagttcctactcgaacgttttcagttcaatgcctaattgtttcaacatcattcagtgcttctcaaaaagtttgctggaggagaaggatctgaaaaggttgatgtccaaaaactgttcggctttctcggacttttcactctttgtcttctctggtggcttggtaagattttcctttttgcaaatttggttgcttaataacgttcaaatctcaatattcattgatagaaatagcatgtaaaaatggaaactgctgttgacatatgagccataatttatgatccaaaatgttctgtatagtgcatgtcaatctttatttggtattctggtaattggtttagttcaaggcntcaagcacatatactttgattgtatttatagttggttcttggtttgnatgaatatacattttttgctgaagtgcttctatctttcagtctggccattaactgcaaatttaattgcttatgcacttattgtggctgtattcatttattaacttatccattgatccaaaatattccgtgcagtatgcatgtcaatgttttatttgggtattctggtctaattggtcgcaaatagcctttgtggacattcttctgtaggtttgttcaaccatatatactttgcatgtatttatggtttgtaatctggtctaaatggtgggcagatacattttgtgtctgaggttcttctgtagtttggttcaaccacatatagttcgcatgcagttatagttgattcttcgtctcaacatacatgtatgcttaagtactcttatcttttcagtctggccattaactgcgctaggcattgagccaaagtttacaatgccccactcagctaaagtggatgaagttgttctggcaaatggccttattgggagtgtgctatcagactatttctggtacacgttaaaaatatactggtgttttttctttctaatatattgcataactgcgttgttttgacaacagaacttctgtgcagggctctatctgttgtttggactaatcccttggtggccaccttaggcatgtcactcacaattccactagcgatggttgctgacatggtcatccatggtcgacattattcagcagtctacattattggttctctacaggtaactgatgccctgaatctccttatttgaggttatgtgaaaagctatatttcaaactccttagttgcactaaacaaaacttgtgttgtcatttcggaagttggaacagctagtgacatccccatgttctgtgaacctctatctatacaagatcactcttatttgcatttgctattttatttgaccctgactatttgcaggtattctctggctttgtcattgccaatcttgccgatcgcttttcacgttttctgggtctatagtcatgaaatctacaaggttgtaccggagtgtacatctgtaaggttagatcgattagctatgnagtgtacattcggaaatccggattggttagtcaaagacaaccatggccttctgttcagaaggattngggaacaagcactgcagctatgtttttctttaacctttggctctctttacacacaaaaatggaggattttgttctgatgaaatagaatacagtaaaagtaggacgcgaaggcacattatgctgtagcaaaactttgcactgtaaattatgtagtagcttgctgcacaatgctttctcaaccgtatactgcatagcgctgttattctcagcagcctcaatcgtcaatgcgttatttttgcaacatgaattgcatacagatgatgaattgagtcgatggaggcactctgagacgtgttaaagttatattatatgtccagttgagctacaccaaagtttccaaaactgaaatataaaatcatatatatgggctttgttggagtatgcgcatgccataataataggacggtaatactatattgaacattcaaacttggtgatggattgattaaagttgataatatttcatactttgtcaacaatagatattactagttcgaaagaaaaacaatactcgatgttacctactcttatcagaaagtcaactcggcacaacttgccgcatgggaccatatattcctgccaccggnaaaaaaacatttcaacatgtcaaaaaattcgaacgaacatttcaacatgtccaaaaaaatatcgaacgaaaattttcgcgtgtacgtatcgacattctatgtgcgaacataagttttgtgaaaaacctatatttttgtgaattgtgtaaaaagacnaaaaaaaaatgtaacttgtgtgaaaaagacaaaaagaaaacgtcaggtagataaccttttttttgtaccaaaattcatcctttttacaaatgataaaatgtcggtttttcggtgaaacgactttctgagcatgtagaatttcaagatgaactcgtcaaattttgtgtcagaatttttcaaaattttaaaagagtatttaaaacgaaatttaaaaatcaggagctctccggctctcttaaattgaattctaacttgttcctatgtcaaacttgtttacatttgaccgactatatagaaaattatactaacatgtacaccaaataagtttttattaaattagtatactgtagattaaactttaagactgtacatgtctgaagttgtagacattataattttggtacnttctccggcccaaattaattgacgcagaagtaacaaatgtgtggatccataatatgataatagagcacacgatttgttaatttgtacagcccaaaaacaattgtatttgcttatcatatttaacacatgcatagtggagcatatacttgcgaacaacaaaaaaatctctaccgttggggtgagtcaaaaagaaatattgtatgataaacccgtgtaacgaagcggagtcagccctctcgagaccgccgtaattcgatgcgatacacggcgaagtcggcgttctgcganggggcgcgcagcagcggcctggtgaccctgtcgacctcggccacgtcgaagccttcttcccgcagcacgtccacgcagtcctgcacgccgcaccgcacctcgctcgccgcccaacacaccgtgccgtcccgccacagccgccgcagcgtggtagccattgccggcatctcctccgggtcgtagaagacgtccgacatgagcaccacgtccacgcacgggacctcacgatcgagcattaccaggtcatactcctccccccagcgcagctcccgcacgtccgcctgcgccgtgtcgaggtcgagcccgttggcctcggcgttggctctaaggcccggcaggagcggccgcacgtccgtgagcacgcagcgcgcggcgccgaggcatgcgacggccgcgatgcccgggaggcccgtgcctgcgccgagctcgagcacggtggcgccgaggagctgactgggctcggccgaggcgaggtggttggtgaggacgagcgcggagtcccatagccaggagccggtgagcgcgcggccggtggccgggtcgtgcgcgccgtcgcgctcaaccacggccagggctcggccggccacatctacctgcagcggcgcatgcatcacgtgtgggttatctgctcgatcgacctcgacgggcgatcacgcgcgctggcgtcgctggggtctggacatcatattacccagctttatatgcaagcttccgaacggatgatggaaggttcaggataatgccgggaccgccgcctggctgtctcgatgatttgtaagcttaccttctatccatgaccggcttggccagccatgcgtgttcaactgttcatgcaccagctaaccgaacccggcgattctacaggcgcgccggtatgtgccggcgtcgcatcgacccttcagctttgcttttagatgcgcgctccgttctcgggtataatgggatgtaccgcttaccgtttccgtttcgatactactccgtcgaataccgaaagcaacgacctgacacctgtcagatacgccaagcatctgggcccatccacgcccaccttccattgaaaatatccgctctctacttcgcgattctctcgttcatctagtcatggagagatcttgagcatgcggcggcggtcatacagtgaagataggacctcctatacgtctgcttcaggcccggcgtcgcccctgcaggtccgaccggtagcctccggttccggcggcggcgccgtcctcaagatccggtcagtagcctccagatccggcgtccccaggtcaaacgtcctaccggcgggggcggccacctccagacacgcatgcccgacgaaaaatacccctggtatcatttcatcgctacctcgncccctgtccattgtctactgtccacctccgatgttgagctctcatgcagatgatgggtgcctggaggcgattgcttcctgcttcttttgatttaagttcatacagcaaatgtaatgcctggtaaatccatttatagttgtgtattgttgcaactgaaattggaatttgacacaggattaaatgcatgattagatttgtgactaagtttatttttgaaactgcagtcgactggtttatcagatgaatttatgcaataaaatagtatctaagtcttcgtaattatctttccaaagaccccgatcttcatgattttggattaatggttgttgaaatatcatcaagtcagtgccgctatttcaggatttcaggantttcagtataaacagatgtttgtttcataagaatctatagtantttccacacaaagtaggtagatganttccttctgatattcagaatgtgcactttttcttgatttgatgaagcgggttgagatttgtagcgtataacaaatatgccatgaacaattttcagaattcagcttaaaggaaagtcgatttcatttatggtgtcctctcatatatattgttggtaagaaatagatatttagttctctttgaattcctctactttgtgtattagtggcttctcgtaccttctaatctcatgttttgcaaagaacttcatccatgnttctattttccgaaattattcatggatcttgctgtctgaatatttttggaactgaaacttcttaaaactagtgaaagtttattggaacacttttgaacaataaatgaagcttcactcgtatatttatgaacaactttgtcgaatctttcaattatttcttatctacttgctttacaattttgtgtgnaatattattagaacttgattccatgcaaactgagtgaactatttgagtgaaatatttctggacttgtaatgtcattgttgcatggttcagttctgttgaacttatctcatagtttgtgaaatctttctttactttatttggnaccagttgaattgtggaaccgtatttaaaaagattgtactagtggaaaaactgttttaacagatgtaacatttcccacaaaccgaagctaaattggtgtgctatttctgtgcaacctaagtgagtttgatttaaaaaatggttagtgaaagagatgttatatgtgaaactgaagcaaaattcttggaaatttattgtgaaatattcccaggaaacctaagtgctctaatttctcacatctggatttccaggaatttactatggccatgttcttggattcttttttcccataggcaaaacgttggcaaggtgcagacttcgtattggcagatgaggacgttgtgtctgaatgtggtacaatagctaacgaaagttgcatggcacaacaacagatctggggtagcaacttgtcatgttcagctggtggtggcaaggataacgagcaacttgttgacagatggtgggcgaatatattagaaatgatagtgtggtgatagcactattgtttttcttgcattatcttctctcgtacagccagattttagcgccaagaagagatgtgctctatgtatgatcttgtaatgttgtttggacctttgtcctgttacagcttttttgtggaacttgcttgacttatctgaattccatcttaacatgtttgctccatttctagactgggacgatttttataaaattatgaaatgcatgttagtatatgcttggaacaattttggtatgaatcatgtaattcgtctagttgactatttgtgagattttttcgcttgtgcaaataacatatcaagctagcatttatcctagtcacctataaactacanttttcacttgtatcgtctcctatgttgagaccctacagaaactaactagaaactaaagtagcgcatcaatgaaacaaataactttactgaaacttcttgnaaccatagtggaaacaagcagccatgttaagtctggatagaacatgccagtaaatcgattgtgacattagcaataccaaataattctgaaaccaactagaaacttcattnaaacattagtnaaacccataacttctctaaaaccttattgaaattctgaataaaacatgaagccatatgnaaccttgatggagtataccacaaanctggatgaggcattagtgcnacccaaatanttccnaaaatttgnacttttaaagtaacaattcatgtttcaatagtttcacatatgtttcactaatgtatggtttatggttgagtacgactacatgcatatttcactatctttcttcaataaatgaaaatataattattcgttggtctttgcatcccataccgaaagtggaatgtacgttcgtaattttgttttcttaagtgcgagtaatggaatgtacatagggtacgcatggaaaaatcatgaagttcatgtttcaattaagtaccaattgtagatacaactctttttgagattttacttanttttttttaggatggactatgtttcacgagttctccatgcatgttttgcttatttaacgataaaggatagaaaatgnttcaataaatttatcctatagtttcactttcttgatcatgtttcatattattttgataacggatggaccgtgtttcacaaaaaatttaataattttgggctatatgaatgtattttacaagttgatcatggaatcatgggagagtttcactaggtttggcatgcttcatattagtatgaaaagatggaagtggttttacttttttttgcatcaatgtaagatctaggttccaattgtttcacaaataattcattaatgcatgtgttataggaaagtatttcacaaattgaccatcgatgtttttccaaataatactatatcataaaagctttcatgatttatcactagagtttgaaatataataatctagttttttttcatttgtaagcgaattgagcttgtttttatgtttcatttaatggtcgaaataaacatattgtagtcnttttttttttaccatggagtgttctaccatgttgggcgtgnttcatattagttcgaaaatgatagaaggtgtttctattttattttgcatcaattcacgagctaggttctaattgnttcaaaaattattcaataatatataggctattggaatgtgnttcacaagttgaccatggaatccttctagtattttacttggatggtcatgttgcacattagtttgaaatagatggacgatgttcgttttttgtatcaaagtaatatccntttttccaattgttgcacaaattattcaataatgcagagcctatgggaatgtgtttcacaagttcaccantcaatccttcttgtctttcaattgtttgggcatgattcctattaattagaaaagtatagagtgtgtttaaatttttttgaatcaactgtaatatctaggtttaagatatttcacaaaaatgtcaattaattggggtatatgcatgtgtttctgaaggtgacaagtgaatcatgggagtgtttcacttggtttggcatgtttcatattagtatgaaaagcatagaggtggtttcacttttttttgcatcaatgtaagatttacgctccaattgtttcaaaaataattcaatgatgcatgggttatatgaatgtgtttcacaagttgaccatggaatccttctagtgtttcactcggatgactgtgttccgcattagtttgcaatggatgtaggttgtttcgatctaggttccagttgtttcaccaaaaatccaataatgcatggactataggaatgtgtttcagaagttcatcatgcaatcattctagtctttcatttggctgggcgtgattcataatagatagaaaagatggaaggtatttcacntttttttttgcatcaaatgtgtttcccaacaatttcaatatttttgggttataggccggaatgtgtttcacaagatggccgtggaatcatgggagaatttcactaggtttggcatatttcatattagtatgaaatggatggaagtggttttttttttgcatcaacgtaagatctaggttccagatttttcacaaatagttcaataatgcatgtgttagaagaaagtatttcacaagtttaccatggnaattttcccaataatctatagggtgccataaatttttacatgatttgtcactagagtttcaaatatagtaatctagttgttgcgttggtaagtaagcaaattgatcttgtttttttatgtttcgttaaccgtcgaaatgaaaatattgtattttatcatgcgagtgtttcactttgttagggatgtttcttattagtttgaaaaggatagagggtgtttcccttttattttgcgtcaatgcacaagctctcggttccaattgtttcaaaaatatttcaataaagtatgggctagtgaaatgtgtttcacaagttcaccatggaatccttcaagcgtttcacttggatgggcatgttccacattagtttgaaatggatggatggtgnttcactttttttaaatgtaatatcttgtttccaattgtttcacattattcaataatccaaggcccattggaatgtatttcacaagttcagcattcaatctttctagtgtttcaattggttctacatgtttcctattaattacaaaaatatggagtgtatttcantttttttgaatcaaatgtctgtagg

SEQ ID NO: 169 - DNA, 1236 bp, Lolium perenne
atggggrcggayttgggrrcggagttgggrgcgctygctctsaagtacacsgggrtgtcgctctcggtgtcggactacgactccatmgtcgccatgaacatcttcgtcgcrctcctctgcggctgcattgtsttcggmcacctgctcgaggggaaccgctgggtcaacgagtccaccaccgcgctmrkcmwggtgyttgcggttttgtctcgcwggggcygggtggcatsgctsatyactggaggggtsatcctgctcgtcaccaatggggtcaattcrcgcattctggtmttcagcgaggatatattcttcatctacttgctcccgccmatcatcttyaacgctgggtttcaagtaaagaaaaarcarttcttccgcaatttygcaacrattactttgttyggggctattgggacattgrtatcctttgtaataatcagcsttggtgccatgggattgttcagcaaacttgatgttgatccactccagcttggggactatcttgcaattggkgctatcttctcagcaacagattctgtttgcaccttrcaggtgcttaaccaggatgaaacacccctactctatagtctggtttttggtgaaggtgttgttaatgatgctacatctgttgtgctmttcaatgcaattsaaaacattgatcttgatcatttcgatgcktttgttctactacaacttattggaaaattcctctacctactkttcaccagtacwgttcttggaatagctytgctggatctragtggtattctcacygtrttcttctgtggaatagtaatgtcgcattacacytggcataatgtgacagaaagctctagggttactaccaagcatacttttgcaaccttatcattcattgctgaaytatttctttttctctacgttgggatggatgcattggacattgaaaaatggagattagctagkagtagggagctaataatatggtgggcaggtctyatgagaggagcagtttcrattgcacttgcttayaacaaggttttyggcttgctgactaagcctctgattaatctcctcatcccaccaaggcctagyaatacagctgatggctcaagccagtcattccttgacccrcttctgagtagcttattrggctcygacttggatattggccaatacccmcctcaaacyaaccttsagcttcttctcacsatacaaacacgttctgttcatcgtgtgtggcgyaagttcgatgat

SEQ ID NO: 170 - DNA, 878 bp, Lolium perenne
atgrgaatagactgtyttstgraaayctgrttamtatgataggygcsgttgctcggataaggcaycagcttgcataygcaacccacactttcttcgayaaagaggatttcttrtatatccatacwcccataataaccaccagygaytgtgagggtgcyggygagatgttccaagtcacmtccttrttcagycaggcygaaaaggttgayaaggagctyaaggagaaccctgcrccrtctgaagctgatrttgaggctgctaagcttgttgtcaagggaaaaggrgatgcrgttgcrcaacttaaagcarcaaaagctagcaagcargagataactgctgctgtttcggagcttacaaaggmaaaagagrytgtcttaaggctggaagaraggtcwaagytgaaacctggrattccycayaragatgatggstccattgcgtttgagaatgacttcttcaagcgtgcagcctttctractgtttcaggccarcttcaggttgagacttaygcttgtgctctcagcagtgtctatacctttggacccacattccgggcagagaactcacatacrtcaagacatttggcagaattttggatggttgaaccrgaaattgcatatgcaaacttgcatgatgatatgractatkcagagaggtacrtaaaatacctctgcaaatggttactygatcattgccgtgaagacatggaattyatggtgaaacatgtggacaagactgcaattgagcgyctggagcttgtttcktcyacaccctttgagcgcatctcatatacwaaggywgtggagatcttagaasgtacrggtaaraaatttgagaacaaggttgaatggggaattgatttagcrtctgagcatgag

SEQ ID NO: 171 - DNA, 478 bp, Lolium perenne
tctcgggaaacacgcattggcaataccggccgatcgatcgacagatcggcacggggtccggcgaggcgcgatggcgtatcgggtgctggaggtgacgctgatcycggccaaggacctgragaaggtgacggtgtycyccaagatgcgkgtgtacgcggtrgcrtccayctccggcggcgacccgcgcacgccgacrcaccrgacgcactcggacyggcamggcgggccgctgcggttcccaatmccgatcgcygccgacccccgcgggctcgcactgcacgtgctcctccgctccgarcgctccttcggcgaccgcgacgtyggcgaggtrctcgtccccgtccaggaccttttcgccgcagcgcctcycgccggcgagcatcgccacctcagctaccaggtgcgacgccccatgagcggccggaagcgcggggtgctccacatctcctacagcctcacggacgcgccggcgataggg

SEQ ID NO: 172 - DNA, 684 bp, Lolium perenne
atgcgcgtcaccatcaccggcggcggsamgmggctgcacgtrgacctctactacgcgygcgtscagagccgcgcgcycttcacggtrtgragcctcctgcagctsatgcggcggcaccscggccgsgtcccsgacktggacctcatgttcgactgcayggaccgsccmgccatcaaccgcacygagcayascgscgagggcgcgccscckccgccrccgctgttccggtactgcaccacycgsgaccacttsgacatcccgttccckgactggtccttctggggmtggccggagacgcacmtcgagccstggagccgygagttcaaragcatymggcagggcgccaagaagaactgggacgaggaggcgaggtccggrtaccagaactcgaagctrtcgagccagtgcacgcaccggtacaagatctacgcggaggggttcgcgtggtcggtgagcctgaartacatyctctcctgcggctcsacggcgctcctgatcgacccgmtgtaccaggacttcttcagccgggggctggagccgcgggtgaaycacctgccggtgagcrccgtsgggatgtgcgagtccatcmgggacgccgtggagtggggcaacgcgcacccggacgaggcggagcgcgtcgggcgrcgcgggcagcggctgatgcaggacctsgccatggrcgcc

SEQ ID NO: 173 - DNA, 2241 bp, Lolium perenne
atggcgggscaggggcaggaccgcaagaccatcgatctggaggaaggatgggcctacatggagggcggcatcggcaagctcgtcaacatcctcgagggcaagaacgagccgcagttcaactccgagaactacatgatgctctacacgacgatwtacaacatgtgcacgcagaagccgcccaacgactactcscagcagctctacgacaagtaccgcgaggcmttcgagaagtacatccgmgacgcggtcttgccagcaatwaaagagcagcatgatgagtatatgctaaaacagctaaamgtaaggtggaagaaccataaagtcatggttcgctggctttcacgtttcttccattaycttgaccgatacttcatcacccggaggtctcttactccacttaatgatgttggstwtatttgcttccgagacttgatatttcaagagatcaaaggaaaggtgaaagatgcrgtgytagttctgataaatcaagagcgtgaaggygaacagattgacaagaccttgctsaaggacgtcytggatatatttgttgaaatygggttaactacyatggagttttatgagaatgactttgaagatttcttgctyaaggatactacagagtactattctgtcaaggctcaaaaytggatcgttgaggattcttgyccagattacatgataaaggctgaggagtgcctgaraagagagaaggagcgagttrgtcactacttgcatattaacagtgagccaaagttgctsgagagagtgcaaaatgaattgctygccaactatgcaacmcaacttctggagaaggaacattctggatgttatgcaytgcttcgrgatgacaaggtggatgatcttaaaaggatgttttcrctcttctcaaaaatcacccgtggwctsgaacctgtttctaacatgttcaaatcgcatgttacgaatgagggtacagctttggtcaagcaagcagaagattctgctagyaataaraagccagagaagaaggagatggttggaatgcaggaacaggtttttgtctggaaaatcattgcactgcatgataagtatgtagcatatgtsacagattgtttccayggccatacactcttccacaaggcacttaaagaagccttygaggtcttctgcaataagggtgtctctggcagttcragygctgaattrctcgccaccttctgtgacaacattytraagaaaggctgyagtgaaaagctcagtgatgaagcyattgaagatgcccttgagaaggtggtgcgsctgctygcatacataagtgataaagayctctttgctgagttctrcaggaagaarctkgcaaggagrttgctwttygacaaragtgctaatgatgarcaygaaagaagcatyctgacraagctwaarcarcagtgtggtggkcartttacttcaaaaatggarggcatggtyactgaycttactsttgcaagagatcatcaaactaagtttgaagagtttgtagctgaacatcaagarttgmatcctgggrtagacttggctgtyactgtyytgacaacaggattctggccaacmtayaaawcwtttgamataarccttcctkctgaratggttaaatgtgtagaggttttcaaggagttytaccaaacaagaacaaagcacaggaagcttacctggatatactcgttrggaacmtgcaatatcaatgcaaaatttgaaaccaaaactatagagctcattgttacaacatatcaggctgcgttgctgttgttattcaatggagttgataggcttagttactctgagattgtaacacagctgaacctgtcrgatgatgatgttgtgcgtttgctccattctctgtcttgcgctaaatacaagattcttaccaaagagccagctggtagatctatttctcccaatgatgttttygagttcaattcaaaattyacygacaggatgagaagaatcaagatacccctgcctcctgttgatgagaagaaaaaggttgttgaagatgttgacaaggayaggaggtaygcaattgatgcrtcgattgtscgtatcatgaaaagccgcaaagtcatggcccatacccagctagttgcggaatgygtggagcagctcagccgcatgttcaagccygacttcaaagcwatcaagaagcggattgaggatctcatcaccagggactacctggagcgtgacaaggacaacgccaacacatacagatatctggcttga

SEQ ID NO: 174 - DNA, 1848 bp, Lolium perenne
atggggtttggtcgatctcgctggacaggcagtacagcactggttattaattggagaccacttctctactgcagaaaagaggatatcaatggtcacagtgggctgaggagagatttaccggttgcatctttgcttcttcgggtggatgcaagcatgtataagaaccagctccaggagcttgcacagaggagctgcttcaacttgccatcctatgcatgcatacgcgaggggccggatcatgcaccccggtttaaggccacagttcatttcaatggggaagcatttgagagcccgacattctgttccaccttgcggctggcggagcatgcggcagctgaggtagcactcaatgagttgtccaagagggggccttcatcatcacttgctgctaaagttctggatgaaactgggatctayaagaacctgctgcargaaactkytcatcgggcyggtttaaaactgccyatgtacactactattagrtccggaccagggcatacaccaatgttcacttgtacagtggagttrgcrggaaggatcttcacrggcaatcctggcaagactaagaaacaagctcaaaaaaatgctgckatggctgcctggtctgaattaaargaattgcctmgagkaggyraggyagcatcttcatcttctccatccgatcatgacaatgrggagcaggaacaggtcacagttgtccgcactcttgaaaryttgaaccagaaaaatgaagkcaaggcmscrcatcaaaaggaaaagcagcaacgcaataaccgcycgcaacctcggagatcwtrtcctaaaccaagtgygtcattttayggatcacgcttacaaaatcagwcrtmcccaaatgtygcacaaragcaagcaatgyaccatatgtggcaccaggtgcarccaacacagcagaagmcccaktttcggatggttccaactwtgggcaacacaaggtttccaccgccaccaacyatactytccatgtaccctccacctagaggacartwcrcyrtgcmagccarccaagatgctttggctctamttcmatgttttcctgaasctgctcctrcccttccacggtayttctcrycttaccctgcctcatacgtaccarcaagtccaytgccarctkcarktaacatgatgcatgggagaagrcaagggtgygmtgaaayggttgagcttcctratgcrccwgttttckscagatacactgctcmagattrctctastgctctggaaaatgtttgtmcaagtgaggttcaacartggcctaaaaatgggaaagaggsawrtmcyragagyagtgstgcyaccgaggaaragaataaagctccccagrcttcktcaagctccacaryrcatcrcccatcacaaaakttrgaasmaaatgaagatarasagtckaaraarscagcagaacarccacttctyggtccataygttgtacaaagacctgyccagcracagarttatcctakycccrtgcagcacagygagcctrtccayagaaatratcttccrttcaggayrgyaacatcacctgrcccatggkyttyggacatgcaractccaccaagatttggyactgsramtcttgcgaattcagccrgtytcttataccagcagcgrcctccatggctggcrgccccagttacagttmgaacttctatccctgtgtgttcagctagaccaaacgcagcggtgaactctagcccgggagcagcaactcgagtccgatctactgtccagatgctctctagaaataactctgaggcccagaggaacacgagagacatgagtgatgcttcgacagcaagttcagaacttagtaagctccatatctga

SEQ ID NO: 175 - DNA, 1206 bp, Lolium perenne
gggaacattgacatttgctccaatgctcgtaatgtttttgcatataatggaccagtcaatttcactgtacttgagaggctagtaagcagatgccgcaacctcaagactctgaagctcaacaatgcaatccctcttgacaatgttgctagcctgcttcgtaaggctccgcamatartagaactyggaactggcaaattytctgckgaytatcatccrgatctytttgcraagsttgargcrgcatttgcaggttgtamaagcctaagaaggctwtctgggrcttgggaygctgttccagattacctgycagcattytatkgtgtatgygaargcctcacatcwcttaayctgagttatgcyacygtkcraggccctgagctcatyaaattyattagcagatgcaagaatctgcwgcarttatgggtgatggayctcattgaggaccatggtctakctrtygtggcatcaasttgcagtaaactrcaagagttgcgggtcttyccttcygayccttttggtcataacgsygggcargttttsttgacwgaaagrggyctygttgatgtttctgccagytgtcccawrttggartcrgtyctytacttctgcagscggatgacgaatgaggctcttrttayrattgcaaagaaccgtccmaacttcacytgcttccgcytakscmtccttgarccycgtwctccrgattacatsacacrrcagyctcttgatgcwggtttcagtgccattgtkgaatcatgcaagggscttaggcgcctctctrtstcyggycttctcwcagatcttgtattyaaatcaatyggtgmacatgctgatcgtcttgagatgctwtcamtmgcmttygctggrracagygatctaggcctgmaykayatcctctcwggctgcaagagcctraagaagctrgagatcagggactgcccrtttgggrataarscgttgctggcaaatgctgccaagytggagacaatgcgatccctttggatgaactcgtgctcgttgaccgtgggcgggtgccgactgcttgcactcaagatgcctcaccttactgtggagataataaacgatcctggagagacatgtccagtggagtcactcccgtttgatagccctgtcgagaaattgtatgtctaccggactcttgcaggtcctagatctgacacaccagactgtgtccagattgtttag

SEQ ID NO: 176 - DNA, 759 bp, Lolium perenne
atggcgcagtccrgcagcgacgccgcmccgatcagcacscaccccaccgaggaggaggaggtsacggtggagmggacgccsgaggaggaggmggccaggctcaggtacctcgagttcgtgcagcaggcggcsgcgcaggcggtsgtgctsgccgcygcggcctacgcstacgcsaagcagggcgcggggccgctccgcccmggmgtcgaccacgtcgagggcaccgtcaaggccgtcgtcggccctgtstaygaycgstaccacgccrtsccgctcgacctcctcaagttcctmgaycgcaaggttgacgagtccgtccaggagctggaccgccgtgtccccccagttgtgaaggaggtgccaacttatgcccgctctgcggcggctgaggtgcacaagaccggcttagtaggcacagccacgggcctggccaagtcggccattgctcgtgctgagccaaaggctcgcgacctgtacacccgctacgagcctgtggcggagcgcaaggctgccgaagcatgggctgccctcaaccgcctcccgcttgttccatcggtgaccagggctgtcctccccaccgctgcacagctctcagccaagtacaactctgccgtgcttgacggggccaagcgcgggaactctgttgccacctacctcccgcttgtccccacggagcgcatcgcgagggtgttctcctacccgcctaccgacgctgctgccacctcggctcctgagatgcagcccatcccgacgcagtaa

SEQ ID NO: 177 - DNA, 828 bp, Lolium perenne
atgctgcgcctgaccctgccctgcccttccaccttgctgatctggcaggaaattctctcatggcaccggatgacctgcagaccaccagcccaggagatatccctcactgaatggtggatagaagcaagacaacgcctggcccccgcgacgctgctcatcctgtggatgacctggaaacaccgcaacagttgcgtgtttgagggtgcacaacctttgatcaatggtctgatctccagcatcaaagatgaaacaattctctgggctaaagccagtgccactggcctaggagtagtgaccgatgacctgggatgttctccatgggttattctaaatcggmggtttatagagtattgtattcttggctgggagaatcttcctcgggttcttctcatgtacttcaacaacgtagtgctgcctcaggaaggatayttccactcagtcatatgcaactcggttgatttccgtaattccactgtgaacaatgatttgaggtacaaggtgtgggatgaaccacctcagacagagcccctatttctgaacatggcacattatgatgagatggtgaacagcggrcagccttttgcaaggcgttttcagaagaaggaacsattgctgracaagatmgatgacaaactactcaggcgtcctgggcatgggcctgttcctggtgcctggtgctcaggcaggaagggctggttcgttgactcatgttcccagtggagtgacgtgaacgttgtgaaacctggtcctcaggccttgaagttgcagcaatatatcaatcggacattggaagaagcaaattctggcgcaaaatcatgcaggcgatag

SEQ ID NO: 178 - DNA, 2796 bp, Lolium perenne
atgggggcggcggagctgctgtctttgtgcttggtactcgctgcggtggcatggacggaggggcagcggccccgcgcggtgaaagtgggcgcgctcttcgactacgattccaccattggccgcgcggcgcagctcgccatcgagctcgccgtcgacgacgtcaacgcggaccgctccgtgctcgcagggaccaagctggacctcatcacggcggacaccaactgcagcggyttygttggaaccgtccaagcactgcaactaatggagaaaaatgtggttgcagttgttggcccrcagtcctctgtgataggccatgtcatctcacattttgttaatgagctgcatgttccgctcctatcattcgcagccactgatccaactctttctgcatcrgagtattcttactttttaaggagcactgtcagcgattacttccaaatgygtgcrattgctagcattgcttmytactatcaatggaaagaggtaactgctatatttgttgatgatgattatgggagaggtggggtgtctgcccttggtgatgcccttgcaacaaagcgtgccagaatttcatataaagcagtmattcctcyagatgckaacaaagatgtgatcagtgatatactgtttaaagttaacatgatggartcaagggttctggttgtgcatgtcaatcctgatacagggctgcgawtattttctatagcyaacgagctccagatgatgascggtggctatgtctggattgtaactgattggctagctgctgtcctggactcctcaaagtcwggatatccgaagarcatgagttatatgcaaggattaattgcccttcgtcagcacattcctgattctgctgccaagaagaagttcatatcaaaatggaataytgyggctcgcaaaaggaaaattgcatctggtttgaattcstatggtttttatgcttatgaytctrtttggattgttgcccatgcgattgayaaatttctcaayagtgggcagmagatcaacttctctgcagatacwagattgcacgattcggatacaagcattatcactctgtcaactctcaagatatttgatggtggtgaacacttgctacagcaacttctgctcacaaactttrmaggcctarcaggtctggtycaatttgatycagaccgcaatttggtacacccagcatatgagatccttaacattggtggttctgttcctgrwttgattggctattggtctaattaytctggcctttctgttgctgctcctgaaactttgtatcagaagccaccaaatatgtcrtcaagtgcccaacagttgagcactrtggygtggtcaggtgrctctaccactaaacccagggggtgggttttcccaaacaatggccagcctctgagaattggtgttccaaataaaccaagyttcaaggaatttgtggcaagtggcaaaggtcctgataacrtgacaggttattgcattgatatattcaatgcagcagttaaactgcttccttaccctgttccttccaaattcatatcaatcggygatggtatacataatcctaaatatgatgacatcattaatatggttgcaaacaakaccattgaygtagctgyaggygacttcgctattatcaaaaatagaacaaggattgcmgaattcacrcagccctatattgagtcagggatggtgatagtagcgccagtgaaacagtcaacttcaagtgcatgggctttctttaarccattcacattagagatgtggtgcgtaactggtgctctttttgtctttgtgggaatagttgtttggattctggaacatcggactaatgaggagttccgaggcacwccacagcaacaagtcckaacaatattttggtttgctttctcaacaatgttctttgcacacmgagaaaacaccgtaagtggtcttgggcgyttcgtyctgatcatatggttatttgtggtgctgatcatcaactcaagttacactgctagtttgacgtcaatcctcacagtccarcagcttgtaaccggagtwactggactggacaatttgattgcaagcactgtacccattggacacccrgctggaaaatttatcmgaaattatctgattgaagagctgaatrttcatgaatcccgcctggtgccaytgaacacgatccaggactatgcggatgcccttaaccgtggaccaaaagctggtggtgttgctgcagttattgatgaaatgccgtgtgttgagctmttcctgtcataccactgtaacttcagaatagtaggtcaggagttyacraaggagggatggggatttgcatttcagmgagattctccrcttgctgcagacatgtcaacggccatccttcaactttcagagastggscagctccagagaattcacgacgagtggttgacgcggccaagttgcagctctgatgatagtgggttgggaccaagcagrctrgatcttggaagcttctggggtcttttcctgctgtgtgctatgatctgcctcttctctcttggggcgttctttgtaaaaataagctgccagtacagcaggtactccasytctgtggctgctggcgaatccagygaagcttctcctacctcccctgctgtttctgaagtacacccracgaaascaaagccaagacgtcttgatagcttcaaagatctgatgyattttgttgacaagaaggaggaagatgttaaaaargaaatgaaacrgagatcaagcgataaagataatcatggygtgggatcctcagatacacactttgtctcttcagcatag

SEQ ID NO: 179 - DNA, 432 bp, Lolium perenne
atggsaccggcgtctacacgcgcggcagcggcactcsaygrcgtgactttagacaacamcgacgccctcgactgcsgcmyttgctgcctaccmctcaagccgcccatcttccagtgtaaggtggggcacgtggtatgctcsmcgtgcmgasacaagctgggggcggctcrgaggtgccatgtgtgtcgcacgrcgacytccggcggataccaycggaaccaygacatggagaagctgctggartcsatycrggtgccttgctccaacgccgcctacggctgygcygccaagccggtctactaygacrgggacacccacctccggttgttctgccagcacgcgccctgccactgcaatatagaagcatgtggcttcgttggctcgacattatcggcgctccttgaccacgtcttcgccgtgcatgttgaataa

SEQ ID NO: 180 - DNA, 1881 bp, Lolium perenne
atggactatacctcggatggagattctgagcttgaagcttatgggtcagacacttatgcacttctgctgtcaggagatatacaagtgatgaatgatgagggcttgtacaaatgccccttttgttcggatgaaaaggatgactataacaaatatgatttactgcagcatgcccttggtgtgggggctgcacatgatcagcaagtgaaagagaaggtagaccatcgagcccttgccaagcatttgaaggatgatgaaccagctaaatcccatagcccactcctgcagccaattgttatagatccacagcctcctcaacataacagagatgacctgtttgtctggccctggatgggtatcatagtcartatgcctyctgartatgttggaaaaagyscaaaccggctsaaggrgcatttctcacgtttytatccygtgaaagtgcaccatgtstacagtaaagstcgccctacaggaaatgctattgttsagtttgggaaggacttggttggttttagaaatgcactarcatttgasaatcaatttgagaaggaagggyatgggaaaatrsgctggcaggaaaaasagcatggagggccagagccttttggatggatcgctagagsagacrattacaatrctccaggagcaayaggggactttctaagaaaaaatggtgatctgaagacggctgacggtgttgaggatgaagaaacaatgaaaaataacaaacttgtggccagtttatcttttaaagttattgaaactgatatgcatatacmagaactkaaatctgtgtatcaggasagaactgcmtcactgaaaagaatgatggagcagagggaacagcagctacagtcatacaatcaagaaatccaaaagatgcaacagctttctgttgaacayacaaraacrattgttgacgagaacaagaagctamgcctggatcttcagtctatgacgcatgagcttgatgcaaggtccaaacaaattgatgagttggcygcacagactgattgtgacagaaraaaccttgaattggagaagcaaaggaatgcmatgaagttcaatcatcttacgctggcagaacrggagtatcagaaagctgatgaaaatgttctaaagcttgtcgaacaacacaagagagaaaaagaaactgctttaaamaatattaagaarttgaacgaaaagctgcatctgacrcayaaacttcaaytggatataaagcacctgacrggaaaattggaagtgataaagctcacaccaggcaatgaaacttcagaatyggggaaaagaatagcggaactgacagaggagctgcgtgataagatcgaggagatggattatacagaaaactacaaccaagatctaatcgtacaagaraaaaagactgctgttgagttgcaagaagctcggaaactggcgatagatgcaatacagcgttttcctggccagacmaktgrcmaagcacacatmggcatsaagatgattggtgagcttgamttgaaagcattttcaaatgtgygcaggcaaaaatttccaaargatgaygcygaagttgaaagtgttaagctttgttcaaagtggcagaatgaaattagsaatccaaactgscatccttttgtggctgctatgktgaayggaaaasagtcggaagtgatcagggaggatgacaagaagctccaggaactgaaagaggagtacggtgaggaagcctatgctgcagttacgacggcgctgaccgagctcaatgagcacagtagcagcggcagcagggttcctttccccgagatgtggaactacaaggaggggaggaaagcgaaaacaaaggaaattgtccagcatgtcatcaagctggccaaggcgagcaaaagggggcgttga

SEQ ID NO: 181 - DNA, 864 bp, Lolium perenne
atggacagggggcgaggtagcgatgaaatgataccaggggtatttttcgtcgggcatgcgtgtctggaggtggccgcccccgccggtaggacgtttgacctggggacgccggatctggaggctactgaccggatcttgaggacggcgccgccgccggaaccggaggctaccggtcggacctgcaggggcgacgccgggcctgaagcagacgtagatgtggccggccgagccctggccgtggttgagcgcgacggcgcgcacgacccggccaccggccgcgcgctcaccggctcctggctatgggactcsgcgmtcgtcctcaccarycrcctcgcytcrgcygwrcccarycmgstcctsggygccrccgygstcgagctyggygymggyacgggcctyccrggcatcgcrgccgtygcwtgcctyggcgccgcgcgstgygtgctcayggaygtgcrrsckctyctgccgggcctyagrgcsaacrccgaggcsaacggrctcgacctcgmcrcsgygyaggyggacgtgcgkgagctgcgstggggggaggagkawgaymtggtrmtgctcgatcgtgagstcscrtgcgtkgacgtggtgctcatgtcggacgtcttctacgacccggaggagatgccggcaatggctaccacgctgcggcggctgtggcgggacggcacggtgtgttgggcggcgagcgaggtgcggtgcggcgtgcaggactgcgtggacgtgctgcgggaagaaggcttcgacgtggccgaggtcgacagggtcaccaggccgctgctgcgcgccccctcgcagaacgccgacttcgccgtgtatcgcatcgaattacggcggtctcgagagggctga

SEQ ID NO: 182 - DNA, 1245 bp, Lolium perenne
atgggttccagyctsaagtaccgcgccggrctcgtcctcatcggcgccgtcgtgctcatatgggtmacctccgccgaggtcacgcaggagatwttcgctgactayaagcaaccrttygcgatcacttacttcggrgcctcccttatggtcatytayatycccytggcrtttctraaggatttcwtatacaaattgytgagaaggcaktctggaagcagcagagcrtcaaargtcgygagcaaatcttcctttggyrgcagcgctcctctgaagaryggygaattygagaagatgctggaaatggarcckcagaaraccgtggtsatarattttacygaygtsracmtccctgtrmtagaagaggcraarccrctkatytgtggaatcggwgarttyggtgatgatgttctsaaggagcaacarctttcmaccaaggagattgcaatttacggattrtatctttgycccatwtggtttgtcacagagtatttatcaaatgcagcccttgcaagaacaagtgttgccagtactackgtactatcttcaacttcgggactcttcacactyttcattagtgtgctccttggccaagattccatwaatgcygccaaagttatwgctgtttttgttagcatggctggtgtagcaatgacwactatgggccagacttgggcaacwgatgaatcwgaagtaagcaatkcaggaaytyatygycttgctaaccrtctaattcwtaagcmtyacwactgcagggccacacagaggactcttctaggtgatatgtttggtcttctgtcagctgtktcrtatggtctcttyactgtgctyctcaaaaagtttgctggmggrgaaggatcwgaaaaggttgatgtccaraaaytsttyggctttctcggacttttyactctytktcttctctggtggctygtctggccrytaacwgcrctaggsatygagccaaagtttacaatgccycactcagcyaaagtggatgaagtkgtkctggcwaatggyctwattgggagtgtgctatcagactatttctgggctctrtcygttgtttggactaaycccytggtggccaccttaggcatgtcactcacaattccactagcgatggttgctgacatggtcatccatggtcgacattattcagcagtctacattattggttctctacaggtattctctggctttgtcattgccaatcttgccgatcgcttttcacgttttctgggtctatag

SEQ ID NO: 183 - DNA, 1749 bp, Lolium perenne
atgaccagcccatccgcgccgccgccctgccctcacctcgccgcgcaccgcctcacctcgcgcccgctccgcttcccccgccgctgcctgcgcgtgcgtccgctcggccgccccgagatccgccgcgacgcgcgcgaggtgccccgctgctccccctgcgcgtcctcctccccgccccccgcccgcctctacgcctgcctctcctgcgcctccgtcttctgcccctcgcacgccgcctcccacgcctcctcctccccgggccaccagatcgcggtcgacgtggaccgcgccgagctcttctgcgccgcctgcggggaccaggtctacgacccggacttcgaccacgccgtcgtcctcgcccagtccaccgcgctcagccccccatccacctccaccccctcacccgctccccgcaagcgccgccgcgtcgactaccgcgcctgggcgccagatccggccgaatccgcgctggtcagcgcggccgccgatcccaccacttcagcgtccacaaccgatccagcgggcctgcgcgggctaaacaacctcggcaacacctgcttcatgaactccgtgctccaggcgctcctccacgcgccgccgctccggaactacttcctcggcgatcgccacaaccgattcctctgcccgcgccgcacgcccatgaggcaccgcgcgaccgatgcggacgccaaggccgcctgcctcgcctgcgatctcgacgagatctactcggccaccttctctggggagcgtacgccatacagccccgccaagttcctctataggtccggatctcaasctckwtttgcattssttsatgycrcgstgtcatttcrgmarcctgctgttctwttttatrctkgctggtggcagcatgcaacaaaccttgcaagctaygagcaacaggatgcmcatgaattttttatctccatccttgaycatattcatgaaaatataaaggatgatgagcacaaatcacatgaacaaggccayggagactgttgcattgcacaycgggtrttttctggtatcctgagatcagatgtcatctgcacaaattgtgggttctcatccacaacttttgaaccttgcatggacttytctttagayytggatgctggatgtaayrkttctcgtggtgttgcaaacccaaaagyacgcaatggagagaggaacttagytrgcatgaatcccaaggtatcatcaacactcatgagatgtttggagcggtttaccagggctgagaggctagatgctgaccagaagttcttctgtgaacgttgcaaggagaggcaagagtcccttaagcaaatgtccattcggaggcttccactagtttcctgctttcacatcaagagatttgagcattcgacagttaagaagatgtcaaggaaggttgatcactctttgcagttccctttttctcttgacatggcaccttacctgtcrtcctcaattctcagaagyagataygggaaccgcatatttccatcagawkccatwgattcagaagcarttycrgaattktcttcagaatttgaaatatttgcrgtgatcacwcatagtggtaagytagatgctggccactaygtsrcttatctcaggttaaacaatcagtggtacagatgcgaygatgcatgggtaaccagagttgaygagcatactgtcaggacttcccaagcatatatgctcttctatgtgcagaagacrctttwctataaagcttgygaaargcyagctgcagtctga

SEQ ID NO: 184 - DNA, 1173 bp, Lolium perenne
atgggcaggcgaggcggcgtgttgtttgtggtggggggaggagacggcgtggcgaggaggcgggatggggaggcggcgccgcgaggaggaggggatgggggcgccggggacggatgcgtgctggggagggggagcgatgggtttctgcgagaggagaatagtggaggcgggatcgctaattacatggtggtagactactacctgtatgactacgagtacgccgagccgccgcgcgtgaccagcctgcagaacgccgttccccagaggaccttcagcgacttcggagatgacgtctacttcgtcgccgacaaacggggctacgagtccgtcgtccactacctcgccggccagtacctcaacaccgacgactccggcaacgtcgccgacccccgcctgcagctcaacaaggtggtgcgagagatctcctactcctcsagyggagtcrcsgtcaagacggaggacgrctcagtgtaccrggcagactatcgtcatsgtctctgccagcttgccatctcayacccarcasaccactctrstaaytactcgatcatactcttgacayttgctatgtcgatcgacctgcargcatggaaratcatcgccatctacmgrttygacatggcagtstacaccaagatcttcctmaarttcccycggaagttctggcccacgggmgamggsaagcagttcttcgtsyacgccagctcyaggcgaggctactaygggatgtggcagtcsttygaggaggagtacccgggrgcyaacgtgctsctsgtgacggtgacggaccargagtcgcggcggatcgagcagcagccggacaacrcsacsatggcrgaggckgtggckgtgctgcgsaggatgttccccgrcgaggacgtcccmgacgccaccgayatctacgtgcccmgstggtggtccaaccgcttcttcaagggctcctactccaactggccyatcggcgtcaaccgctacgaataygaccagcttckggcgccggtgggrcgggtctacttcactkgggagcacaccagmgarcactacaatggctatgtccatggaggttatcttgcaggcacggattctgctgacattctgatgaacagtatcttcaacaacgtggagtttaaagtccgcggcaagtaccatgaccagaccgcagaggctaaatga

SEQ ID NO: 185 - DNA, 1257 bp, Lolium perenne
atggccgaggccgacgatgccgcggccgcccgccgacgcaccgtggtcaccgactaccgcaacaagctcctsaactgccgcgagctggagacgagggtccgcacagaattagaacttgacagaggawakaagagtgactacccagtatctygatcagctagggagaacctwaaaaaggcaaagaaagattatgataaaacrgaagatgacttgaagtcyttgcagagtgtgggccaaatcattggkgaagtacttcggccattggacactgaaagatttatygtcaargccagyagtgggccacrttatgtrgttggctgcagragyaaagttgacaaagaaaagctracagctggaacgcgggttgttcttgacaygacaactttaaccattatgmgmactctaccrcgygaggytgatccggtggtctataacatgctacaygaagacccwggcaaygtcagttaytcagctgtaggtggattatcrgatcaaataagggaactgcgggagtctatcgagttaccgcttatgaatcctgaactctttctccgtgttgggattaaaccgccaaagggtgttctgctctatggcccacctggaackgggaagacaytgcttgctagagctatygctagcaacatygatgcaaactttttaaaraagattgtttcaagtgctatcattgacaaatatatyggtgaragtgcccgtcttatamgagaaatgttcaactatgcacgcgagcatcaaccatgyattattttcatggatgaaatygatgccattggtggccgaagattyagygagggmacyagygcwgaycgkgaratccaacggacattgatggagctcctaaatcagttagatggattygatgagcttgggaaggtcaagatgatyatggcraccaacmgkcctgatgtsttggatcctgcactccttcgtcctggacgcttggaccggaagatagaaatyccattgccraatgagcartcsagrayrgaggtsctraaaatccaygcrgcyggtatygccaaacatggcgarattgattatgaggctrttgttaagctygctgagggcttcaayggygccgatttgcgcaatgtctgcactgaagctggcatggctgccatycgrgcagagcgtgactacgtcatccatgargacttcatgaaggcggtgcgaaagctgaatgatgccaagaagctcgagtctagcgcccactacagcgcagactttggcaaggaataa

SEQ ID NO: 186 - DNA, 3264 bp, Lolium perenne
atgacaaagctcaagagcgtggcgtccacggtgggggcggcggaggagtgcgcggggagcgctcggcagattgccccgtcgccgatgaagctgctggtgcgcgtcgtggaggcgcggggcctgctggcggtgcacgtcaacggcaccagcgaccccttcgtcaagctgcagctcggcaagcgccgggccaagaccgccgtcgtcaagaagaacctcgcccccgtctgggacgaggagttcagcttcctcgtcggcgacgtcaccgaggagctcgccgtatccgtgctcaacgaggacaagtacttcagcaacgaccacctcggmagggtcaaggtgccmctctcmcaggtcatggacaccgacggcctctccctcggyaccgcatggtaccagctccagccaaagagcagcaagtccaagaggaaatgccgyggggaaatctgcytgcgcatatccttgtcyacacgracgcacrtgtccgragaaytgcamcctctaccrcgccccacytcrgamggcgtatcatccagttcagacaggtcratcgggaccaarcgyggagctctgtcaaccaccaacagctacattgacctstcmgcygtggccrgcttggaccgaggrtcscagagcagcttcgarcgrtcsgcrgatagcttcgtggascagccrcccmggagcagcrtcgarcargcagycrccgagcctggracgkccgctgaaacygakrcgrygrccaacacrtcrtcgatggtrgaggtcttgtckcgctayttctttcggaaacctgycgaygcygykgtgsytgcrgytgtctcygaygccgagtcgrtggtggatcagtcsccrgagycgaaagyktgctctgaagaacgtgaargycctgagaaycgcrygccacctgagwcragccttgatgagctactraaaatyatggagtccaaagatcarggckctgaaatgccagcyaarctgtcwaayggcgtkctggtygaygaatcytaygtyastgcaccrgcyggactgaatasgctmttgttttctccaaattcagayttctggccggcwgtagcagarcttcaaggaacaagtggrtttcagattgarycrtggaagatcgatagcaaygatggttgtttgcgaagaacattrasttacataaaagcwgcgagtaagytggttaaagctkksaargcyacagaagagcagaartacttgaargcagctgggaattcttttgctgttytgtctattgttagcactcctgakgtyccttgyggmamytgtttcaagatagagataytgtactstataacrccaggtccscakttatcwtcwgaagarcaaacggcacaccttactgtaagttggcggatmaactttgtycagagcacaatgataaaaggaatgattgaaaatggggcaaaacaaggcatgtcagaaggttatgcacaattttctgaagtactrtcccaaaagtttaarrtagctgagctygatgatgctaatgcaarcaaagcaaagattttrgcttcrctgcatacacaaaaagaaccragctggaggctgattgtccgcttcctygggarcttcacattcatagtctctgttatcgtrgggmtatatattatarcacaccttcatttrtcaaagcccaaagcgatgaatgggctygagtattttggcattgaccttccmgattcaattggagaggtcgtggtttgtgctgtgttgatccttcagggacagaatatcatgaaagtaatgaagcgcttttygaatgcatggaaacaaagaggtagtgatcatggagtcaaagctcatggrgatggttggatactgactgttgcacttattgagggcastggtatartarytgkygrttcctctggcttayttgatctttatgctgtttttacttgcaatrcgaagaggaaaacaagctcaattaaattccacacctctgatccaaaatggaatgagatattcgaatttgatgcaatggatgatccaccatcaaggatggatgtggctattcatgattctaatcgatcygatggagatccyrttggtcaygctgaagtraactttctgamragcagtttgtcagatttaactgacatatgggttcctctwgatgggaagtgtgatccagcaagcaaccckaagctacacttamgaatmttyttgaacaaytcaagaggaactgaagttgtcatgaattacctgtcaaagatggggaaagaagtcggtaagaagataaatttgcgktcagcwcaaacaaattcmgcattccggaagctttttaacctccctccagaagagtttctcattgatgatttcacctgccatctaaaacggaagatgccactgcaggttatccctcmtacactgtcaattggcagyccatccttgatggtcatcctgaraaaggatagagggtcagaagcaaaacatggtgccaagggaacmgataacaatggaagattgaagttccattttcagtcctttgtttcgttcggtgatgctcacagaataattatggggatytggaaaaygcggtcaccgggtccagaacagaagggggagataatkgaggagwctgaacyraaagaactcccggcygaagaatcrgggtccttatttagccatgaagatgtyaaaatgtctgaaatattctcrtcagttmtctctgtggacaaatatataccagmggcaaatcaaatcaactacaagtttgacaaagcattgtctcgatctggaggagaagcaagcaccactcaacagaagtatgccctagtgaaccaagatggstgggccattgaagaggtgatgacactccaaggtgttctacttgsggactactttagttttgacaaaccattctcaagatatggaggagaagcaaccaccactcagcagacgtatgctctagtgaaccaagacggctgggccattgaagaggtgatgaccctccaaggtgttctacttggggactgcttcactctccakctccagctraagtatcatatggcgaaygtrccrscraaaccaaacacctgcagtgtgcaggttttgttggggattgcctggttaaagagcaccaascarcaaaagaaggtcacaaaaaatatcatgtcgaatacctcwaatagattgaaggagctmttttctgaagtygaaaaggatcttacgtcaagaaacggtaccctttttagcgcatctattgatccttaccgttctttayatgatyctaatatcacgtaa

SEQ ID NO: 187 - DNA, 2022 bp, Lolium perenne
atgaagaagctaggaggtggaggcataccacaagatgcaggtttatcagattttctgaagaacaggctacagaagataccaaggatttctgcccccactcagcttttcttgggtccgcccctgcatagaagtagaaccgtagaaacaccatgtggaggcaaaatcccttcatcagaggagttttssttgatwttaccccttcttgctgtctcgcgtctgtcccgtacgaactctctacgaacagagtccgtcgagtyaccygtgcccgacgccttcgcygycctcmccrccgccgacgccgaygaagycggaaccagcagctccrccgscgscggcggcgcarmcgcatcaaatcccatmtccccrcgctccagcaacyctctcccctccrccacctccgccacaacccctctcgagctgcccggcgtamcycycgccgcstccgcrcgaaaccctaagatccaccacacccrcggygtcctccacctctaccgctcctccccmtccytgcccgcytcatcctacgcctccgccgtcgccgtcgccgycaccccctcctcytcctcctccgggccyrccsccccaccgctccaatscgastcsctrctcccgtcatggcgcggcacgcgcctccttgtgctcgcygtccctacccgcgtctcgccsgasgacttcgtccgyttttgcggcccctacgtygakcacgcctccgagatccgtgtcatcagcgacgayggrgtggaggaccgstacagcktgcttgtggagtttgaggatcaaaagagtgcygayggattctacctggacctcaatggctggaggttctcgtcctcagaggttgtaataktgccartttggygccagttggtagaggtgtgccatgttctgtttatagttgctgtgcaatacatgccatccgctgtgccaccagttggatctacygagcttccgacwtgtcctgtttgcatwgaaaggttggatcaagacatcagtggaattgtggcaaccaattgtgaccattctttccagtgttcatgcgtttcaatgtgggtcagttcatcttgtccggtttgtcagttttgycagaagcagtctgaaactcctacaaatcctacatgttctgtttgtcagacctctgaaaacctytggatctgtgtgatatgtggttttgttggatgyggaaggtataaagaaggccactcaattaggcactggaaagayactcagcaytgctattctctygatttggaaactcaacgtgtttgggattatgtcggtgacagttatgttcatcgtcttaatcactcgaaaagcgatgcaaaacattctaagctcaggtcaaagtgtgaattttctggggacaacgatgactyggatatgggtggagttatgtttagcagcaaaactgatacaatcgtggatgaatacaaccgtcttcttgcaagccaacttgaaactcagagagagtattacgaggctcttctgtcagacgctaagaaagatagggaacacatttctgttgctgtggataaagctgtaaatgataagcttcaagagatgcaacttaagcttgaaaatactatgttggagaaaaagaaagttgcagaaatgaatgaaaaactcatgaagagccaggatatatggtccaagacagtaaaaggaatagaggaaagggagagagcgcagttgaggctgaaggatgatacaattcttgacctggaagaacagattaaagacttcaagtactcgattaagttgcaaaaatcgatagagaagagtacacatgctgatgatctcaaaggaggtatgctggtgccactggccatggaatcagaatctggaaagggtgcagagtttgagcattatgtcaacatgtgtaaaaaagatcatgaggcaccataccaaaaaaatttattaccatctaggaaaaactctgactcaatggaaaaattactcatcccaccaaaaaccacaccaccaagcttgttgtttgataccctcaaggtcaagagcatgggataa

SEQ ID NO: 188 - DNA, 615 bp, Lolium perenne
atgtcgargctgaccgtgggggtrwgcaycatggtggcgctcagyctggccgtcttcytcaccatcgtcrtcctcctcctsgccgacctmttctgctcccacctccgcckccgccgmctycgcgctgacgcsgmsatggcrccgcacaagaggccraagcwyggcgycccggygtcgtccccrccgyacaccrccgacgaygcgtcsgtggccaccaccaccacsacggcgacgcacgaggcgctctccagcacccygcccttctactacrcgcacggygtcatgtgcrcgcccacccgcaakgacctcctcctcgccatccccragctsgaggccrccgtgyggaagtggtctcccgcgygccgctcctcgmcgtcgccktcgccrcckyggtccgagcccaccgcccrcgartcctyctccyccgcktacagcracggcttcctgcgcayctccaaccccgtrtacgagcggggcgcyayggccgssccsggcgrgyacgaagaagacaygcygttcgacacgcctgrcrcrtcgccrtccccgaatgggattacagaggaagagggggcttttggacgtgtcaaccacacgcatcagggagcccgatcatga

SEQ ID NO: 189 - DNA, 630 bp, Lolium perenne
atggcgcctcttgccgcsgcrgcsgcsgcggtggcggcsaaggaggagctgggcgtgacggtggccrtggcgccgccgatggcgctggccccgctgagccagcagcakccgcggcggyagtaccgcggygtgygcatgcgsaagtggggcaagwgrgtggcggagatccrggagccgcacaagygywygcgyatctggctcggctcctacrccacgcccgysgccgccgcgcgyrcctacgayacggycgtsttctacctgygcggccgstcggccaggctcaacttccccgacgagatctccgcgctsgcgccgctstccccgcckcccgaggagctggaggcsgacggcggcgcgctgtcggyggcgtcgatcyggaagaaggccatcgaggtcgggtcccgcgtsgacrcgctscagaccggsatgacsatggtcgccrcsgccgccgcgccgrcgacraaccascgsgagcggcagaggcagcascacrcrcagcagcaggckgcgcgygaygaggagctgctccwgctccaccaccagaagcagcagcrgacggygtggaacgggcgggccaagaacccggatctcaaccagrcgcccgacccsgacagctccgacgccgagtga

SEQ ID NO: 190 - protein, 412 aa, Lolium perenne
  MISC_FEATURE (3)..(3)
  MISC_FEATURE (7)..(7)
  MISC_FEATURE (19)..(19): X is M or V
  MISC_FEATURE (63)..(63)
  MISC_FEATURE (64)..(64): X is K, M, Q or L
  MISC_FEATURE (66)..(66): X is L or F
  MISC_FEATURE (72)..(72): X is R or W
  MISC_FEATURE (74)..(74): X is R or W
  MISC_FEATURE (77)..(77): X is S or W
  MISC_FEATURE (140)..(140): X is I or V
  misc_feature (141)..(141): Xaa can be any naturally occurring amino acid
  MISC_FEATURE (148)..(148): X is L or V
  MISC_FEATURE (216)..(216): X is Q or E
  misc_feature (217)..(217): Xaa can be any naturally occurring amino acid
  MISC_FEATURE (315)..(315): X is R or S
  MISC_FEATURE (393)..(393): X is Q or E
MGXDLGXELGALALKYTGXSLSVSDYDSIVAMNIFVALLCGCIVFGHLLEGNRWVNESTTALXXVXAVLSRXGXVAXLITGGVILLVTNGVNSRILVFSEDIFFIYLLPPIIFNAGFQVKKKQFFRNFATITLFGAIGTLXSFVIISXGAMGLFSKLDVDPLQLGDYLAIGAIFSATDSVCTLQVLNQDETPLLYSLVFGEGVVNDATSVVLFNAIXNIDLDHFDAFVLLQLIGKFLYLLFTSTVLGIALLDLSGILTVFFCGIVMSHYTWHNVTESSRVTTKHTFATLSFIAELFLFLYVGMDALDIEKWRLAXSRELIIWWAGLMRGAVSIALAYNKVFGLLTKPLINLLIPPRPSNTADGSSQSFLDPLLSSLLGSDLDIGQYPPQTNLXLLLTIQTRSVHRVWRKFDD

SEQ ID NO: 191 - protein, 281 aa, Lolium perenne
  MISC_FEATURE (72)..(72): X is I or V
  MISC_FEATURE (92)..(92): X is T or A
  MISC_FEATURE (109)..(109): X is E or A
  MISC_FEATURE (112)..(112): X is T, I, A or V
  MISC_FEATURE (129)..(129): X is K or R
  MISC_FEATURE (203)..(203): X is N or D
  MISC_FEATURE (205)..(205): X is A or S
  MISC_FEATURE (209)..(209): X is I or V
  MISC_FEATURE (255)..(255): X is A or V
  MISC_FEATURE (261)..(261): X is R or G
MIGAVARIRHQLAYATHTFFDKEDFLYIHTPIITTSDCEGAGEMFQVTSLFSQAEKVDKELKENPAPSEADXEAAKLVVKGKGDAVAQLKAXKASKQEITAAVSELTKXKEXVLRLEERSKLKPGIPHXDDGSIAFENDFFKRAAFLTVSGQLQVETYACALSSVYTFGPTFRAENSHTSRHLAEFWMVEPEIAYANLHDDMXYXERYXKYLCKWLLDHCREDMEFMVKHVDKTAIERLELVSSTPFERISYTKXVEILEXTGKKFENKVEWGIDLASEHE

SEQ ID NO: 192 - protein, 159 aa, Lolium perenne
  MISC_FEATURE (35)..(35): X is P or L
  MISC_FEATURE (40)..(40): X is E or G
  MISC_FEATURE (46)..(46): X is P or L
  MISC_FEATURE (50)..(50): X is G or C
  MISC_FEATURE (54)..(54): X is S or G
  MISC_FEATURE (55)..(55): X is I or V
  MISC_FEATURE (66)..(66): X is T or A
  MISC_FEATURE (72)..(72): X is P or L
  MISC_FEATURE (82)..(82): X is T or P
  MISC_FEATURE (85)..(85): X is R or C
  MISC_FEATURE (100)..(100): X is T or A
  MISC_FEATURE (108)..(108): X is R or W
  MISC_FEATURE (111)..(111): X is T or A
SRETRIGNTGRSIDRSARGPARRDGVSGAGGDADXGQGPXEGDGVXQDAXVRGXXHLRRRPAHADXPDALGXARRAAAVPNXDRXRPPRARTARAPPLRXLLRRPRRXRGXRPRPGPFRRSASRRRASPPQLPGATPHERPEARGAPHLLQPHGRAGDR

SEQ ID NO: 193 - protein, 228 aa, Lolium perenne
  MISC_FEATURE (10)..(10): X is K or T
  MISC_FEATURE (20)..(20): X is R or C
  MISC_FEATURE (26)..(26): X is P or L
  MISC_FEATURE (30)..(30): X is missing or W
  MISC_FEATURE (40)..(40): X is P or R
  MISC_FEATURE (46)..(46): X is V or L
  MISC_FEATURE (53)..(53): X is T or M
  MISC_FEATURE (64)..(64): X is T or S
  MISC_FEATURE (65)..(65): X is A or G
  MISC_FEATURE (84)..(84): X is F or L
  MISC_FEATURE (101)..(101): X is I or L
  misc_feature (169)..(169): Xaa can be any naturally occurring amino acid
  MISC_FEATURE (189)..(189): X is T or A
  MISC_FEATURE (227)..(227): X is D or G
MRVTITGGGXRLHVDLYYAXVQSRAXFTVXSLLQLMRRHXGRVPDXDLMFDCXDRPAINRTEHXXEGAPPPPPLFRYCTTRDHXDIPFPDWSFWGWPETHXEPWSREFKSIRQGAKKNWDEEARSGYQNSKLSSQCTHRYKIYAEGFAWSVSLKYILSCGSTALLIDPXYQDFFSRGLEPRVNHLPVSXVGMCESIRDAVEWGNAHPDEAERVGRRGQRLMQDLAMXA

SEQ ID NO: 194 - protein, 746 aa, Lolium perenne
  MISC_FEATURE (100)..(100): X is K or N
  MISC_FEATURE (138)..(138): X is Y or F
  MISC_FEATURE (234)..(234): X is K or R
  MISC_FEATURE (241)..(241): X is S or G
  MISC_FEATURE (441)..(441): X is Y or C
  MISC_FEATURE (488)..(488): X is L or V
  MISC_FEATURE (507)..(507): X is N or H
  MISC_FEATURE (510)..(510): X is I or V
  MISC_FEATURE (527)..(527): X is S or T
  MISC_FEATURE (529)..(529): X is E or D
  misc_feature (531)..(531): Xaa can be any naturally occurring amino acid
  MISC_FEATURE (534)..(534): X is A or S
MAGQGQDRKTIDLEEGWAYMEGGIGKLVNILEGKNEPQFNSENYMMLYTTIYNMCTQKPPNDYSQQLYDKYREAFEKYIRDAVLPAIKEQHDEYMLKQLXVRWKNHKVMVRWLSRFFHYLDRYFITRRSLTPLNDVGXICFRDLIFQEIKGKVKDAVLVLINQEREGEQIDKTLLKDVLDIFVEIGLTTMEFYENDFEDFLLKDTTEYYSVKAQNWIVEDSCPDYMIKAEECLXREKERVXHYLHINSEPKLLERVQNELLANYATQLLEKEHSGCYALLRDDKVDDLKRMFSLFSKITRGLEPVSNMFKSHVTNEGTALVKQAEDSASNKKPEKKEMVGMQEQVFVWKIIALHDKYVAYVTDCFHGHTLFHKALKEAFEVFCNKGVSGSSSAELLATFCDNILKKGCSEKLSDEAIEDALEKVVRLLAYISDKDLFAEFXRKKLARRLLFDKSANDEHERSILTKLKQQCGGQFTSKMEGMVTDLTXARDHQTKFEEFVAEHQELXPGXDLAVTVLTTGFWPTYKXFXIXLPXEMVKCVEVFKEFYQTRTKHRKLTWIYSLGTCNINAKFETKTIELIVTTYQAALLLLFNGVDRLSYSEIVTQLNLSDDDVVRLLHSLSCAKYKILTKEPAGRSISPNDVFEFNSKFTDRMRRIKIPLPPVDEKKKVVEDVDKDRRYAIDASIVRIMKSRKVMAHTQLVAECVEQLSRMFKPDFKAIKKRIEDLITRDYLERDKDNANTYRYLA

SEQ ID NO: 195 - protein, 615 aa, Lolium perenne
  MISC_FEATURE (147)..(147): X is A, V, S or F
  MISC_FEATURE (210)..(210): X is G or V
  MISC_FEATURE (212)..(212): X is K or E
  MISC_FEATURE (213)..(213): X is A or V
  MISC_FEATURE (225)..(225): X is E or G
  MISC_FEATURE (238)..(238): X is N or S
  MISC_FEATURE (245)..(245): X is G or V
  MISC_FEATURE (248)..(248): X is P or A
  MISC_FEATURE (260)..(260): X is P or S
  MISC_FEATURE (266)..(266): X is Y or C
  MISC_FEATURE (271)..(271): X is A or V
  MISC_FEATURE (282)..(282): X is T or S
  MISC_FEATURE (283)..(283): X is Y or S
  MISC_FEATURE (289)..(289): X is K or E
  MISC_FEATURE (293)..(293): X is H or Y
  MISC_FEATURE (306)..(306): X is T or P
  MISC_FEATURE (307)..(307): X is Qor H
  MISC_FEATURE (314)..(314): X is M or L
  MISC_FEATURE (336)..(336): X is Y or F
  MISC_FEATURE (337)..(337): X is T or A
  MISC_FEATURE (338)..(338): X is M or V
  MISC_FEATURE (339)..(339): X is Q or P
  MISC_FEATURE (341)..(341): X is N or S
  MISC_FEATURE (348)..(348): X is I or L
  MISC_FEATURE (349)..(349): X is Q or P
  MISC_FEATURE (354)..(354): X is P or A
  MISC_FEATURE (357)..(357): X is T or A
  MISC_FEATURE (364)..(364): X is P or S
  MISC_FEATURE (372)..(372): X is T or A
  MISC_FEATURE (377)..(377): X is T or A
  MISC_FEATURE (378)..(378): X is A or S
  MISC_FEATURE (379)..(379): X is S, I, G or V
  MISC_FEATURE (390)..(390): X is D or A
  misc_feature (392)..(392): Xaa can be any naturally occurring amino acid
  MISC_FEATURE (397)..(397): X is N or D
  MISC_FEATURE (402)..(402): X is A, G, S or C
  MISC_FEATURE (407)..(407): X is Q or P
  MISC_FEATURE (409)..(409): X is Y or C
  MISC_FEATURE (411)..(411): X is T or S
  MISC_FEATURE (418)..(418): X is T or P
  MISC_FEATURE (431)..(431): X is A  or G
  MISC_FEATURE (432)..(432): X is N, S, Y or C
  MISC_FEATURE (433)..(433): X is T or P
  MISC_FEATURE (434)..(434): X is K or E
  MISC_FEATURE (437)..(437): X is A or G
  MISC_FEATURE (442)..(442): X is K or E
  MISC_FEATURE (448)..(448): X is T or A
  MISC_FEATURE (454)..(454): X is T, I, M, A or V
  MISC_FEATURE (456)..(456): X is H or R
  MISC_FEATURE (460)..(460): X is K or N
  MISC_FEATURE (463)..(463): X is Q, P, E or A
  MISC_FEATURE (467)..(467): X is K or R
  MISC_FEATURE (468)..(468): X is Q or E
  MISC_FEATURE (472)..(472): X is P or A
  MISC_FEATURE (487)..(487): X is A or V
  MISC_FEATURE (489)..(489): X is Q or R
  MISC_FEATURE (491)..(491): X is N or S
  MISC_FEATURE (494)..(494): X is S or I
  MISC_FEATURE (496)..(496): X is M or V
  MISC_FEATURE (502)..(502): X is I or V
  MISC_FEATURE (506)..(506): X is N or D
  MISC_FEATURE (511)..(511): X is T, I or M
  MISC_FEATURE (512)..(512): X is A or V
  MISC_FEATURE (516)..(516): X is D or G
  MISC_FEATURE (519)..(519): X is A, V, S or F
  MISC_FEATURE (520)..(520): X is S or L
  MISC_FEATURE (531)..(531): X is A or G
  MISC_FEATURE (532)..(532): X is N or T
  MISC_FEATURE (538)..(538): X is S or G
  MISC_FEATURE (539)..(539): X is L or F
MGFGRSRWTGSTALVINWRPLLYCRKEDINGHSGLRRDLPVASLLLRVDASMYKNQLQELAQRSCFNLPSYACIREGPDHAPRFKATVHFNGEAFESPTFCSTLRLAEHAAAEVALNELSKRGPSSSLAAKVLDETGIYKNLLQETXHRAGLKLPMYTTIRSGPGHTPMFTCTVELAGRIFTGNPGKTKKQAQKNAAMAAWSELKELPRXGXXASSSSPSDHDNXEQEQVTVVRTLEXLNQKNEXKAXHQKEKQQRNNRXQPRRSXPKPSXSFYGSRLQNQXXPNVAQXQAMXHMWHQVQPTQQKXXFRMVPTXGNTRFPPPPTILSMYPPPRGQXXXXAXQDALALXXCFPEXAPXLPRYFSXYPASYVPXSPLPXXXNMMHGRRQGCXEXVELPXAPVFXRYTAXDXSXALENVCXSEVQQWPKNGKEXXXXSSXATEEXNKAPQXSSSSTXHXPSQXLEXNEDXXSKKXAEQPLLGPYVVQRPXQXQXYPXPXQHSEPXHRNXLPFRXXTSPXPWXXDMQTPPRFGTXXLANSAXXLYQQRPPWLAAPVTVRTSIPVCSARPNAAVNSSPGAATRVRSTVQMLSRNNSEAQRNTRDMSDASTASSELSKLHI

SEQ ID NO: 196 - protein, 401 aa, Lolium perenne
  MISC_FEATURE (57)..(57): X is Q or H
  MISC_FEATURE (59)..(59): X is I or V
  MISC_FEATURE (78)..(78): X is L or V
  MISC_FEATURE (86)..(86): X is K or T
  MISC_FEATURE (94)..(94): X is T or A
  MISC_FEATURE (103)..(103): X is P or S
  MISC_FEATURE (107)..(107): X is G or C
  MISC_FEATURE (111)..(111): X is S or G
  MISC_FEATURE (123)..(123): X is Q or R
  MISC_FEATURE (138)..(138): X is Q or L
  MISC_FEATURE (152)..(152): X is A or S
  MISC_FEATURE (153)..(153): X is I or V
  MISC_FEATURE (157)..(157): X is T or S
  MISC_FEATURE (176)..(176): X is A or G
  MISC_FEATURE (180)..(180): X is F or L
  MISC_FEATURE (195)..(195): X is K, I or M
  MISC_FEATURE (204)..(204): X is S or R
  MISC_FEATURE (212)..(212): X is I or V
  MISC_FEATURE (213)..(213): X is T, I or M
  MISC_FEATURE (227)..(227): X is A, G, S or C
  MISC_FEATURE (228)..(228): X is I or L
  MISC_FEATURE (233)..(233): X is T or S
  misc_feature (237)..(237): Xaa can be any naturally occurring amino acid
  MISC_FEATURE (239)..(239): X is Q or R
  MISC_FEATURE (241)..(241): X is P or S
  MISC_FEATURE (261)..(261): X is I, M or V
  MISC_FEATURE (266)..(266): X is T or S
  MISC_FEATURE (275)..(275): X is E or A
  MISC_FEATURE (285)..(285): X is I or L
  MISC_FEATURE (290)..(290): X is N or D
  MISC_FEATURE (296)..(296): X is N or H
  MISC_FEATURE (297)..(297): X is D or Y
  MISC_FEATURE (317)..(317): X is N or D
  MISC_FEATURE (319)..(319): X is P or A
GNIDICSNARNVFAYNGPVNFTVLERLVSRCRNLKTLKLNNAIPLDNVASLLRKAPXIXELGTGKFSADYHPDLFAKXEAAFAGCXSLRRLSGXWDAVPDYLXAFYXVCEXLTSLNLSYATVXGPELIKFISRCKNLXQLWVMDLIEDHGLXXVASXCSKLQELRVFPSDPFGHNXGQVXLTERGLVDVSASCPXLESVLYFCXRMTNEALXXIAKNRPNFTCFRLXXLEPRXPDYXTXQXLDAGFSAIVESCKGLRRLSXSGLLXDLVFKSIGXHADRLEMLSXAFAGXSDLGLXXILSGCKSLKKLEIRDCPFGXKXLLANAAKLETMRSLWMNSCSLTVGGCRLLALKMPHLTVEIINDPGETCPVESLPFDSPVEKLYVYRTLAGPRSDTPDCVQIV

SEQ ID NO: 197 - protein, 252 aa, Lolium perenne
  MISC_FEATURE (5)..(5): X is S or G
  MISC_FEATURE (31)..(31): X is E or A
  MISC_FEATURE (90)..(90): X is I, M or V
MAQSXSDAAPISTHPTEEEEVTVERTPEEEXARLRYLEFVQQAAAQAVVLAAAAYAYAKQGAGPLRPGVDHVEGTVKAVVGPVYDRYHAXPLDLLKFLDRKVDESVQELDRRVPPVVKEVPTYARSAAAEVHKTGLVGTATGLAKSAIARAEPKARDLYTRYEPVAERKAAEAWAALNRLPLVPSVTRAVLPTAAQLSAKYNSAVLDGAKRGNSVATYLPLVPTERIARVFSYPPTDAAATSAPEMQPIPTQ

SEQ ID NO: 198 - protein, 275 aa, Lolium perenne
  MISC_FEATURE (203)..(203): X is P or R
  MISC_FEATURE (206)..(206): X is N or D
MLRLTLPCPSTLLIWQEILSWHRMTCRPPAQEISLTEWWIEARQRLAPATLLILWMTWKHRNSCVFEGAQPLINGLISSIKDETILWAKASATGLGVVTDDLGCSPWVILNRRFIEYCILGWENLPRVLLMYFNNVVLPQEGYFHSVICNSVDFRNSTVNNDLRYKVWDEPPQTEPLFLNMAHYDEMVNSGQPFARRFQKKEXLLXKIDDKLLRRPGHGPVPGAWCSGRKGWFVDSCSQWSDVNVVKPGPQALKLQQYINRTLEEANSGAKSCRR

SEQ ID NO: 199 - protein, 931 aa, Lolium perenne
  MISC_FEATURE (148)..(148): X is R or C
  MISC_FEATURE (155)..(155): X is Y or S
  MISC_FEATURE (198)..(198): X is P or L
  MISC_FEATURE (232)..(232): X is I or L
  MISC_FEATURE (243)..(243): X is T or S
  MISC_FEATURE (268)..(268): X is N or S
  MISC_FEATURE (297)..(297): X is T or I
  MISC_FEATURE (298)..(298): X is A or V
  MISC_FEATURE (319)..(319): X is I or V
  MISC_FEATURE (335)..(335): X is K or Q
  MISC_FEATURE (376)..(376): X is K, T, E or A
  MISC_FEATURE (379)..(379): X is T or A
  MISC_FEATURE (386)..(386): X is P or S
  MISC_FEATURE (406)..(406): X is E, G or D
  MISC_FEATURE (442)..(442): X is M or V
  MISC_FEATURE (443)..(443): X is A or V
  MISC_FEATURE (447)..(447): X is D or G
  MISC_FEATURE (487)..(487): X is M or V
  MISC_FEATURE (532)..(532): X is K or N
  MISC_FEATURE (538)..(538): X is A or V
  MISC_FEATURE (621)..(621): X is R or L
  MISC_FEATURE (710)..(710): X is I or V
  MISC_FEATURE (793)..(793): X is T or S
  MISC_FEATURE (857)..(857): X is T or S
  MISC_FEATURE (882)..(882): X is P or A
  MISC_FEATURE (895)..(895): X is H or Y
  MISC_FEATURE (910)..(910): X is Q or R
MGAAELLSLCLVLAAVAWTEGQRPRAVKVGALFDYDSTIGRAAQLAIELAVDDVNADRSVLAGTKLDLITADTNCSGFVGTVQALQLMEKNVVAVVGPQSSVIGHVISHFVNELHVPLLSFAATDPTLSASEYSYFLRSTVSDYFQMXAIASIAXYYQWKEVTAIFVDDDYGRGGVSALGDALATKRARISYKAVIPXDANKDVISDILFKVNMMESRVLVVHVNPDTGLRXFSIANELQMMXGGYVWIVTDWLAAVLDSSKSGYPKXMSYMQGLIALRQHIPDSAAKKKFISKWNXXARKRKIASGLNSYGFYAYDSXWIVAHAIDKFLNSGQXINFSADTRLHDSDTSIITLSTLKIFDGGEHLLQQLLLTNFXGLXGLVQFDXDRNLVHPAYEILNIGGSVPXLIGYWSNYSGLSVAAPETLYQKPPNMSSSAQQLSTXXWSGXSTTKPRGWVFPNNGQPLRIGVPNKPSFKEFVASGKGPDNXTGYCIDIFNAAVKLLPYPVPSKFISIGDGIHNPKYDDIINMVANXTIDVAXGDFAIIKNRTRIAEFTQPYIESGMVIVAPVKQSTSSAWAFFKPFTLEMWCVTGALFVFVGIVVWILEHRTNEEFRGTPQQQVXTIFWFAFSTMFFAHRENTVSGLGRFVLIIWLFVVLIINSSYTASLTSILTVQQLVTGVTGLDNLIASTVPIGHPAGKFIRNYLIEELNXHESRLVPLNTIQDYADALNRGPKAGGVAAVIDEMPCVELFLSYHCNFRIVGQEFTKEGWGFAFQRDSPLAADMSTAILQLSEXGQLQRIHDEWLTRPSCSSDDSGLGPSRLDLGSFWGLFLLCAMICLFSLGAFFVKISCQYSRYSXSVAAGESSEASPTSPAVSEVHPTKXKPRRLDSFKDLMXFVDKKEEDVKKEMKXRSSDKDNHGVGSSDTHFVSSA

SEQ ID NO: 200 - protein, 143 aa, Lolium perenne
  MISC_FEATURE (2)..(2): X is A or G
  MISC_FEATURE (13)..(13): X is H or D
  MISC_FEATURE (14)..(14): X is D or G
  MISC_FEATURE (20)..(20): X is N or T
  MISC_FEATURE (26)..(26): X is R or G
  MISC_FEATURE (27)..(27): X is T, I, P or L
  MISC_FEATURE (48)..(48): X is T or P
  MISC_FEATURE (51)..(51): X is H or D
  MISC_FEATURE (57)..(57): X is Q or R
  MISC_FEATURE (65)..(65): X is T or A
  MISC_FEATURE (84)..(84): X is Q or R
  MISC_FEATURE (103)..(103): X is R or G
MXPASTRAAAALXXVTLDNXDALDCXXCCLPLKPPIFQCKVGHVVCSXCRXKLGAAXRCHVCRTXTSGGYHRNHDMEKLLESIXVPCSNAAYGCAAKPVYYDXDTHLRLFCQHAPCHCNIEACGFVGSTLSALLDHVFAVHVE

SEQ ID NO: 201 - protein, 626 aa, Lolium perenne
  MISC_FEATURE (122)..(122): X is N or S
  MISC_FEATURE (125)..(125): X is P or S
  MISC_FEATURE (132)..(132): X is P or A
  MISC_FEATURE (137)..(137): X is E or G
  MISC_FEATURE (154)..(154): X is A or G
  MISC_FEATURE (163)..(163): X is Q or E
  MISC_FEATURE (176)..(176): X is T or A
  MISC_FEATURE (178)..(178): X is D or E
  MISC_FEATURE (186)..(186): X is H or Y
  MISC_FEATURE (189)..(189): X is I or M
  MISC_FEATURE (190)..(190): X is R or G
  MISC_FEATURE (195)..(195): X is Q or E
  MISC_FEATURE (208)..(208): X is A or G
  MISC_FEATURE (210)..(210): X is N or D
  MISC_FEATURE (213)..(213): X is T or A
  MISC_FEATURE (217)..(217): X is T or I
  MISC_FEATURE (260)..(260): X is Q or P
  MISC_FEATURE (268)..(268): X is D or E
  MISC_FEATURE (303)..(303): X is K or R
  MISC_FEATURE (313)..(313): X is S or R
  MISC_FEATURE (342)..(342): X is K or R
  MISC_FEATURE (363)..(363): X is Q or R
  MISC_FEATURE (388)..(388): X is K or N
  MISC_FEATURE (428)..(428): X is S or L
  MISC_FEATURE (486)..(486): X is S or I
  MISC_FEATURE (487)..(487): X is D or G
  MISC_FEATURE (488)..(488): X is K or Q
  MISC_FEATURE (493)..(493): X is  I or M
  MISC_FEATURE (500)..(500): X is  E or D
  MISC_FEATURE (508)..(508): X is  R or C
  MISC_FEATURE (533)..(533): X is S or R
  MISC_FEATURE (537)..(537): X is C or W
  MISC_FEATURE (545)..(545): X is V or L
  MISC_FEATURE (549)..(549): X is Q or E
MDYTSDGDSELEAYGSDTYALLLSGDIQVMNDEGLYKCPFCSDEKDDYNKYDLLQHALGVGAAHDQQVKEKVDHRALAKHLKDDEPAKSHSPLLQPIVIDPQPPQHNRDDLFVWPWMGIIVXMPXEYVGKSXNRLKXHFSRFYPVKVHHVYSKXRPTGNAIVXFGKDLVGFRNALXFXNQFEKEGXGKXXWQEKXHGGPEPFGWIARXDXYNXPGAXGDFLRKNGDLKTADGVEDEETMKNNKLVASLSFKVIETDMHIXELKSVYQXRTASLKRMMEQREQQLQSYNQEIQKMQQLSVEHTXTIVDENKKLXLDLQSMTHELDARSKQIDELAAQTDCDRXNLELEKQRNAMKFNHLTLAEXEYQKADENVLKLVEQHKREKETALXNIKKLNEKLHLTHKLQLDIKHLTGKLEVIKLTPGNETSEXGKRIAELTEELRDKIEEMDYTENYNQDLIVQEKKTAVELQEARKLAIDAIQRFPGQTXXXAHIGXKMIGELXLKAFSNVXRQKFPKDDAEVESVKLCSKWQNEIXNPNXHPFVAAMXNGKXSEVIREDDKKLQELKEEYGEEAYAAVTTALTELNEHSSSGSRVPFPEMWNYKEGRKAKTKEIVQHVIKLAKASKRGR

SEQ ID NO: 202 - protein, 287 aa, Lolium perenne
  MISC_FEATURE (105)..(105): X is I or L
  MISC_FEATURE (109)..(109): X is N or S
  MISC_FEATURE (110)..(110): X is H or R
  MISC_FEATURE (115)..(115): X is E or V
  MISC_FEATURE (117)..(117): X is N or S
  MISC_FEATURE (118)..(118): X is Q or P
  MISC_FEATURE (119)..(119): X is L or V
  MISC_FEATURE (123)..(123): X is T or A
  MISC_FEATURE (124)..(124): X is A or V
  MISC_FEATURE (125)..(125): X is L or V
  MISC_FEATURE (129)..(129): X is A or V
  MISC_FEATURE (150)..(150): X is T or M
  MISC_FEATURE (153)..(153): X is Q or R
  MISC_FEATURE (154)..(154): X is P or A
  MISC_FEATURE (163)..(163): X is T or A
  MISC_FEATURE (171)..(171): X is D or A
  MISC_FEATURE (172)..(172): X is T or A
  MISC_FEATURE (173)..(173): X is A or V
  MISC_FEATURE (174)..(174): X is Q or missing
  MISC_FEATURE (175)..(175): X is A or V
  MISC_FEATURE (186)..(186): X is E, D, Y or missing
  MISC_FEATURE (188)..(188): X is M or L
  MISC_FEATURE (190)..(190): X is M or L
  MISC_FEATURE (195)..(195): X is L or V
  MISC_FEATURE (196)..(196): X is P or A
MDRGRGSDEMIPGVFFVGHACLEVAAPAGRTFDLGTPDLEATDRILRTAPPPEPEATGRTCRGDAGPEADVDVAGRALAVVERDGAHDPATGRALTGSWLWDSAXVLTXXLASAXPXXXLGAXXXELGXGTGLPGIAAVACLGAARCVLXDVXXLLPGLRANXEANGLDLXXXXXDVRELRWGEEXDXVXLDREXXCVDVVLMSDVFYDPEEMPAMATTLRRLWRDGTVCWAASEVRCGVQDCVDVLREEGFDVAEVDRVTRPLLRAPSQNADFAVYRIELRRSREG

SEQ ID NO: 203 - protein, 414 aa, Lolium perenne
  MISC_FEATURE (62)..(62): X is I or L
  MISC_FEATURE (69)..(69): X is Q or H
  MISC_FEATURE (79)..(79): X is A or V
  MISC_FEATURE (86)..(86): X is N or S
  MISC_FEATURE (86)..(86): X is S or G
  MISC_FEATURE (92)..(92): X is N or S
  MISC_FEATURE (110)..(110): X is N or D
  MISC_FEATURE (115)..(115): X is N or D
  MISC_FEATURE (116)..(116): X is I or L
  MISC_FEATURE (119)..(119): X is I or L
  MISC_FEATURE (234)..(234): X is A or S
  MISC_FEATURE (236)..(236): X is T or I
  MISC_FEATURE (237)..(237): X is H or Y
  MISC_FEATURE (238)..(238): X is R or C
  MISC_FEATURE (242)..(242): X is H or R
  MISC_FEATURE (245)..(245): X is H or L
  MISC_FEATURE (247)..(247): X is H or P
  MISC_FEATURE (248)..(248): X is H or Y
  MISC_FEATURE (249)..(249): X is N or Y
  misc_feature (294)..(294): Xaa can be any naturally occurring amino acid
  MISC_FEATURE (304)..(304): X is C or F
MGSSLKYRAGLVLIGAVVLIWVTSAEVTQEIFADYKQPFAITYFGASLMVIYIPLAFLKDFXYKLLRRXSGSSRASKVXSKSSFGXSAPLKXGEFEKMLEMEPQKTVVIXFTDVXXPVXEEAKPLICGIGEFGDDVLKEQQLSTKEIAIYGLYLCPIWFVTEYLSNAALARTSVASTTVLSSTSGLFTLFISVLLGQDSINAAKVIAVFVSMAGVAMTTMGQTWATDESEVSNXGXXXLANXLIXKXXXCRATQRTLLGDMFGLLSAVSYGLFTVLLKKFAGGEGSEKVDVQKXFGFLGLFTLXLLWWLVWPLTALGIEPKFTMPHSAKVDEVVLANGLIGSVLSDYFWALSVVWTNPLVATLGMSLTIPLAMVADMVIHGRHYSAVYIIGSLQVFSGFVIANLADRFSRFLGL

SEQ ID NO: 204 - protein, 583 aa, Lolium perenne
  MISC_FEATURE (267)..(267): X is P or A
  MISC_FEATURE (268)..(268): X is R or L
  MISC_FEATURE (271)..(271): X is F or L
  MISC_FEATURE (272)..(272): X is L or V
  MISC_FEATURE (273)..(273): X is H or D
  MISC_FEATURE (274)..(274): X is A or V
  MISC_FEATURE (275)..(275): X is T or A
  MISC_FEATURE (276)..(276): X is L or V
  MISC_FEATURE (279)..(279): X is Q or R
  MISC_FEATURE (280)..(280): X is K or Q
  MISC_FEATURE (287)..(287): X is T or A
  MISC_FEATURE (288)..(288): X is G or C
  MISC_FEATURE (377)..(377): X is S, I, G or V
  MISC_FEATURE (386)..(386): X is A or V
  MISC_FEATURE (394)..(394): X is A or V
  MISC_FEATURE (395)..(395): X is S or G
  misc_feature (499)..(499): Xaa can be any naturally occurring amino acid
  MISC_FEATURE (500)..(500): X is E or D
  MISC_FEATURE (501)..(501): X is A or S
  MISC_FEATURE (507)..(507): X is I or V
  MISC_FEATURE (508)..(508): X is P or S
  MISC_FEATURE (510)..(510): X is L or F
  MISC_FEATURE (533)..(533): X is T or A
  MISC_FEATURE (573)..(573): X is Y or F
  MISC_FEATURE (579)..(579): X is K or R
  MISC_FEATURE (580)..(580): X is P or L
MTSPSAPPPCPHLAAHRLTSRPLRFPRRCLRVRPLGRPEIRRDAREVPRCSPCASSSPPPARLYACLSCASVFCPSHAASHASSSPGHQIAVDVDRAELFCAACGDQVYDPDFDHAVVLAQSTALSPPSTSTPSPAPRKRRRVDYRAWAPDPAESALVSAAADPTTSASTTDPAGLRGLNNLGNTCFMNSVLQALLHAPPLRNYFLGDRHNRFLCPRRTPMRHRATDADAKAACLACDLDEIYSATFSGERTPYSPAKFLYRSGSQXXFAXXXXXXSFXXPAVLFYXXWWQHATNLASYEQQDAHEFFISILDHIHENIKDDEHKSHEQGHGDCCIAHRVFSGILRSDVICTNCGFSSTTFEPCMDFSLDLDAGCNXSRGVANPKXRNGERNLXXMNPKVSSTLMRCLERFTRAERLDADQKFFCERCKERQESLKQMSIRRLPLVSCFHIKRFEHSTVKKMSRKVDHSLQFPFSLDMAPYLSSSILRSRYGNRIFPSXEXIDSEAXXEXSSEFEIFAVITHSGKLDAGHYVXYLRLNNQWYRCDDAWVTRVDEHTVRTSQAYMLFYVQKTLXYKACEXXAAV

SEQ ID NO: 205 - protein, 390 aa, Lolium perenne
  MISC_FEATURE (149)..(149): X is T or A
  MISC_FEATURE (155)..(155): X is D or G
  MISC_FEATURE (159)..(159): X is Q or R
  MISC_FEATURE (165)..(165): X is R or G
  MISC_FEATURE (173)..(173): X is H or Y
  MISC_FEATURE (175)..(175): X is T or A
  MISC_FEATURE (176)..(176): X is H or D
  MISC_FEATURE (179)..(179): X is T, S, A or G
  MISC_FEATURE (188)..(188): X is L or F
  MISC_FEATURE (226)..(226): X is E or D
  MISC_FEATURE (233)..(233): X is H or Y
  MISC_FEATURE (276)..(276): X is T or A
  MISC_FEATURE (291)..(291): X is D or G
  MISC_FEATURE (304)..(304): X is S or R
  MISC_FEATURE (331)..(331): X is R or L
  MISC_FEATURE (341)..(341): X is G or W
  MISC_FEATURE (345)..(345): X is R or S
MGRRGGVLFVVGGGDGVARRRDGEAAPRGGGDGGAGDGCVLGRGSDGFLREENSGGGIANYMVVDYYLYDYEYAEPPRVTSLQNAVPQRTFSDFGDDVYFVADKRGYESVVHYLAGQYLNTDDSGNVADPRLQLNKVVREISYSSSGVXVKTEDXSVYXADYRHXLCQLAISXPXXHSXNYSIILLTXAMSIDLQAWKIIAIYRFDMAVYTKIFLKFPRKFWPTGXGKQFFVXASSRRGYYGMWQSFEEEYPGANVLLVTVTDQESRRIEQQPDNXTMAEAVAVLRRMFPXEDVPDATDIYVPXWWSNRFFKGSYSNWPIGVNRYEYDQLXAPVGRVYFTXEHTXEHYNGYVHGGYLAGTDSADILMNSIFNNVEFKVRGKYHDQTAEAK

SEQ ID NO: 206 - protein, 418 aa, Lolium perenne
  MISC_FEATURE (43)..(43): X is K, N, Y or missing
  MISC_FEATURE (51)..(51): X is R or missing
  MISC_FEATURE (102)..(102): X is H or R
  MISC_FEATURE (126)..(126): X is T or M
  MISC_FEATURE (133)..(133): X is R or S
  MISC_FEATURE (139)..(139): X is A or V
  MISC_FEATURE (306)..(306): X is R or S
  MISC_FEATURE (335)..(335): X is T, I or M
  MISC_FEATURE (356)..(356): X is I or V
MAEADDAAAARRRTVVTDYRNKLLNCRELETRVRTELELDRGXKSDYPVSXSARENLKKAKKDYDKTEDDLKSLQSVGQIIGEVLRPLDTERFIVKASSGPXYVVGCRSKVDKEKLTAGTRVVLDXTTLTIMXTLPREXDPVVYNMLHEDPGNVSYSAVGGLSDQIRELRESIELPLMNPELFLRVGIKPPKGVLLYGPPGTGKTLLARAIASNIDANFLKKIVSSAIIDKYIGESARLIREMFNYAREHQPCIIFMDEIDAIGGRRFSEGTSADREIQRTLMELLNQLDGFDELGKVKMIMATNXPDVLDPALLRPGRLDRKIEIPLPNEQSRXEVLKIHAAGIAKHGEIDYEAXVKLAEGFNGADLRNVCTEAGMAAIRAERDYVIHEDFMKAVRKLNDAKKLESSAHYSADFGKE

SEQ ID NO: 207 - protein, 1087 aa, Lolium perenne
  MISC_FEATURE (159)..(159): X is M or V
  MISC_FEATURE (161)..(161): X is E or G
  MISC_FEATURE (164)..(164): X is Q or H
  MISC_FEATURE (172)..(172): X is E or D
  MISC_FEATURE (203)..(203): X is S or G
  MISC_FEATURE (221)..(221): X is D or E
  MISC_FEATURE (228)..(228): X is I or V
  MISC_FEATURE (232)..(232): X is A or V
  MISC_FEATURE (233)..(233): X is T or A
  MISC_FEATURE (238)..(238): X is A or S
  MISC_FEATURE (242)..(242): X is E or D
  MISC_FEATURE (243)..(243): X is T or A
  MISC_FEATURE (244)..(244): X is T, M, A or V
  MISC_FEATURE (245)..(245): X is T or A
  MISC_FEATURE (263)..(263): X is A or V
  MISC_FEATURE (266)..(266): X is A or V
  MISC_FEATURE (268)..(268): X is P, L, A or V
  MISC_FEATURE (270)..(270): X is  A or V
  MISC_FEATURE (277)..(277): X is M or V
  MISC_FEATURE (284)..(284): X is P or S
  MISC_FEATURE (286)..(286): X is A or V
  MISC_FEATURE (293)..(293): X is S or G
  MISC_FEATURE (298)..(298): X is T, M, A or V
  MISC_FEATURE (302)..(302): X is T or S
  misc_feature (318)..(318): Xaa can be any naturally occurring amino acid
  MISC_FEATURE (336)..(336): X is T or S
  MISC_FEATURE (343)..(343): X is T or R
  MISC_FEATURE (369)..(369): X is P or S
  MISC_FEATURE (384)..(384): X is T or S
  MISC_FEATURE (396)..(396): X is G, V, C, F, W or L
  MISC_FEATURE (422)..(422): X is E or D
  MISC_FEATURE (427)..(427): X is N or T
  MISC_FEATURE (436)..(436): X is S or C
  MISC_FEATURE (442)..(442): X is Q or H
  MISC_FEATURE (495)..(495): X is I or V
  MISC_FEATURE (504)..(504): X is N or S
  MISC_FEATURE (529)..(529): X is N or S
  MISC_FEATURE (540)..(540): X is I or L
  MISC_FEATURE (544)..(544): X is T or A
  MISC_FEATURE (592)..(592): X is S or L
  MISC_FEATURE (621)..(621): X is T or S
  MISC_FEATURE (624)..(624): X is I or V
  MISC_FEATURE (625)..(625): X is T, I, A or V
  MISC_FEATURE (626)..(626): X is G or V
  MISC_FEATURE (627)..(627): X is D or G
  MISC_FEATURE (632)..(632): X is L or F
  MISC_FEATURE (642)..(642): X is T or A
  MISC_FEATURE (689)..(689): X is I or V
  MISC_FEATURE (698)..(698): X is K or T
  MISC_FEATURE (795)..(795): X is H or P
  MISC_FEATURE (809)..(809): X is K or R
  MISC_FEATURE (852)..(852): X is T or M
  MISC_FEATURE (864)..(864): X is M or I
  MISC_FEATURE (867)..(867): X is T or S
  MISC_FEATURE (869)..(869): X is P or L
  MISC_FEATURE (896)..(896): X is I or L
  MISC_FEATURE (904)..(904): X is E or A
  MISC_FEATURE (952)..(952): X is A or G
  MISC_FEATURE (1003)..(1003): X is Q or H
  MISC_FEATURE (1015)..(1015): X is P or A
  MISC_FEATURE (1035)..(1035): X is N or K
  MISC_FEATURE (1082)..(1082): X is H or Y
  MISC_FEATURE (1084)..(1084): X is P or S
MTKLKSVASTVGAAEECAGSARQIAPSPMKLLVRVVEARGLLAVHVNGTSDPFVKLQLGKRRAKTAVVKKNLAPVWDEEFSFLVGDVTEELAVSVLNEDKYFSNDHLGRVKVPLSQVMDTDGLSLGTAWYQLQPKSSKSKRKCRGEICLRISLSTRTHXSXELXPLPRPTSXGVSSSSDRSIGTKRGALSTTNSYIDLSAVAXLDRGSQSSFERSADSFVXQPPRSSXEQAXXEPGTXAETXXXXNTSSMVEVLSRYFFRKPXDAXVXAXVSDAESXVDQSPEXKXCSEEREXPENRXPPEXSLDELLKIMESKDQGXEMPAKLSNGVLVDESYVXAPAGLNXLLFSPNSDFWPAVAELQGTSGFQIEXWKIDSNDGCLRRTLXYIKAASKLVKAXKATEEQKYLKAAGNSFAVLSIVSTPXVPCGXCFKIEILYXITPGPXLSSEEQTAHLTVSWRINFVQSTMIKGMIENGAKQGMSEGYAQFSEVLSQKFKXAELDDANAXKAKILASLHTQKEPSWRLIVRFLGXFTFIVSVIVGXYIIXHLHLSKPKAMNGLEYFGIDLPDSIGEVVVCAVLILQGQNIMKVMKRFXNAWKQRGSDHGVKAHGDGWILTVALIEGXGIXXXXSSGLXDLYAVFTCNXKRKTSSIKFHTSDPKWNEIFEFDAMDDPPSRMDVAIHDSNRSDGDPXGHAEVNFLXSSLSDLTDIWVPLDGKCDPASNPKLHLRIFLNNSRGTEVVMNYLSKMGKEVGKKINLRSAQTNSAFRKLFNLPPEEFLIDDFTCHLKRKMPLQVIPXTLSIGSPSLMVILXKDRGSEAKHGAKGTDNNGRLKFHFQSFVSFGDAHRIIMGIWKXRSPGPEQKGEIXEEXEXKELPAEESGSLFSHEDVKMSEIFSSVXSVDKYIPXANQINYKFDKALSRSGGEASTTQQKYALVNQDGWAIEEVMTLQGVLLXDYFSFDKPFSRYGGEATTTQQTYALVNQDGWAIEEVMTLQGVLLGDCFTLXLQLKYHMANVPXKPNTCSVQVLLGIAWLKSTXQQKKVTKNIMSNTSNRLKELFSEVEKDLTSRNGTLFSASIDPYRSLXDXNIT

SEQ ID NO: 208 - protein, 673 aa, Lolium perenne
  MISC_FEATURE (62)..(62): X is S, C or W
  MISC_FEATURE (86)..(86): X is S or L
  MISC_FEATURE (94)..(94): X is A or V
  MISC_FEATURE (96)..(96): X is T or P
  MISC_FEATURE (97)..(97): X is T or A
  MISC_FEATURE (103)..(103): X is A or V
  MISC_FEATURE (109)..(109): X is T or A
  MISC_FEATURE (110)..(110): X is A or G
  MISC_FEATURE (111)..(111): X is A or G
  MISC_FEATURE (115)..(115): X is N, T, D or A
  MISC_FEATURE (127)..(127): X is P or S
  MISC_FEATURE (131)..(131): X is T or A
  MISC_FEATURE (144)..(144): X is T or P
  MISC_FEATURE (145)..(145): X is P or L
  MISC_FEATURE (158)..(158): X is H or R
  MISC_FEATURE (183)..(183): X is A or V
  MISC_FEATURE (193)..(193): X is T or A
  MISC_FEATURE (194)..(194): X is P or A
  MISC_FEATURE (199)..(199): X is S or C
  MISC_FEATURE (200)..(200): X is D or E
  MISC_FEATURE (223)..(223): X is D or E
  MISC_FEATURE (234)..(234): X is E or D
  MISC_FEATURE (253)..(253): X is V or L
  MISC_FEATURE (283)..(283): X is V or L
  MISC_FEATURE (285)..(285): X is I or V
  MISC_FEATURE (287)..(287): X is R or C
  MISC_FEATURE (458)..(458): X is S or L
MKKLGGGGIPQDAGLSDFLKNRLQKIPRISAPTQLFLGPPLHRSRTVETPCGGKIPSSEEFXLILPLLAVSRLSRTNSLRTESVEXPVPDAFAXLXXADADEXGTSSSXXXGGAXASNPISPRSSNXLPSXTSATTPLELPGVXXAASARNPKIHHTXGVLHLYRSSPSLPASSYASAVAVAXTPSSSSSGPXXPPLQXXSLLPSWRGTRLLVLAVPTRVSPXDFVRFCGPYVXHASEIRVISDDGVEDRYSXLVEFEDQKSADGFYLDLNGWRFSSSEVVIXPXWXQLVEVCHVLFIVAVQYMPSAVPPVGSTELPTCPVCIERLDQDISGIVATNCDHSFQCSCVSMWVSSSCPVCQFCQKQSETPTNPTCSVCQTSENLWICVICGFVGCGRYKEGHSIRHWKDTQHCYSLDLETQRVWDYVGDSYVHRLNHSKSDAKHSKLRSKCEFSGDNDDXDMGGVMFSSKTDTIVDEYNRLLASQLETQREYYEALLSDAKKDREHISVAVDKAVNDKLQEMQLKLENTMLEKKKVAEMNEKLMKSQDIWSKTVKGIEERERAQLRLKDDTILDLEEQIKDFKYSIKLQKSIEKSTHADDLKGGMLVPLAMESESGKGAEFEHYVNMCKKDHEAPYQKNLLPSRKNSDSMEKLLIPPKTTPPSLLFDTLKVKSMG

SEQ ID NO: 209 - protein, 204 aa, Lolium perenne
  MISC_FEATURE (3)..(3): X is K or R
  MISC_FEATURE (9)..(9): X is S or C
  MISC_FEATURE (10)..(10): X is T or I
  MISC_FEATURE (20)..(20): X is L or F
  MISC_FEATURE (24)..(24): X is I or V
  MISC_FEATURE (37)..(37): X is R or L
  MISC_FEATURE (45)..(45): X is D, E or A
  MISC_FEATURE (54)..(54): X is H or L
  MISC_FEATURE (56)..(56): X is A or V
  MISC_FEATURE (58)..(58): X is A or V
  MISC_FEATURE (63)..(63): X is H or Y
  MISC_FEATURE (65)..(65): X is T or A
  MISC_FEATURE (86)..(86): X is  P or L
  MISC_FEATURE (91)..(91): X is  T or A
  MISC_FEATURE (97)..(97): X is  T or A
  MISC_FEATURE (101)..(101): X is  K or N
  MISC_FEATURE (109)..(109): X is  K or E
  MISC_FEATURE (113)..(113): X is  T or A
  MISC_FEATURE (115)..(115): X is  R or W
  MISC_FEATURE (121)..(121): X is  R or C
  MISC_FEATURE (125)..(125): X is  T or P
  MISC_FEATURE (131)..(131): X is  R or W
  MISC_FEATURE (137)..(137): X is  H or R
  MISC_FEATURE (140)..(140): X is S or F
  MISC_FEATURE (142)..(142): X is P or S
  MISC_FEATURE (146)..(146): X is N or D
  MISC_FEATURE (151)..(151): X is T or I
  MISC_FEATURE (161)..(161): X is T or M
  MISC_FEATURE (163)..(163): X is A or G
  MISC_FEATURE (166)..(166): X is E or G
  MISC_FEATURE (167)..(167): X is H or Y
  MISC_FEATURE (171)..(171): X is T or M
  MISC_FEATURE (172)..(172): X is P or L
  MISC_FEATURE (177)..(177): X is D or G
  MISC_FEATURE (178)..(178): X is T or A
MSXLTVGVXXMVALSLAVFXTIVXLLLADLFCSHLRXRRLRADAXMAPHKRPKXGXPXSSPPXTXDDASVATTTTTATHEALSSTXPFYYXHGVMCXPTRXDLLLAIPXLEAXVXKWSPAXRSSXSPSPPXSEPTAXESXSXAYSXGFLRXSNPVYERGAXAXPGXXEEDXXFDTPXXSPSPNGITEEEGAFGRVNHTHQGARS

SEQ ID NO: 210 - protein, 209 aa, Lolium perenne
  MISC_FEATURE (23)..(23): X is M or V
  MISC_FEATURE (36)..(36): X is Q or H
  MISC_FEATURE (40)..(40): X is Q or missing
  MISC_FEATURE (45)..(45): X is R or C
  MISC_FEATURE (52)..(52): X is R, W or missing
  MISC_FEATURE (57)..(57): X is Q or R
  MISC_FEATURE (62)..(62): X is R or C
  MISC_FEATURE (63)..(63): X is T, M, S or L
  MISC_FEATURE (71)..(71): X is T or A
  MISC_FEATURE (74)..(74): X is A or V
  MISC_FEATURE (79)..(79): X is T or A
  MISC_FEATURE (83)..(83): X is A or V
  MISC_FEATURE (88)..(88): X is R or C
  MISC_FEATURE (122)..(122): X is A or V
  MISC_FEATURE (126)..(126): X is R or W
  MISC_FEATURE (138)..(138): X is T or A
  MISC_FEATURE (148)..(148): X is T or A
  MISC_FEATURE (153)..(153): X is T or A
  MISC_FEATURE (156)..(156): X is H or Q
  MISC_FEATURE (163)..(163): X is H or Q
  MISC_FEATURE (165)..(165): X is T or A
  MISC_FEATURE (177)..(177): X is Q or L
  MISC_FEATURE (185)..(185): X is Q or R
  MISC_FEATURE (187)..(187): X is A or V
  MISC_FEATURE (200)..(200): X is T or A
MAPLAAAAAAVAAKEELGVTVAXAPPMALAPLSQQXPRRXYRGVXMRKWGKXVAEIXEPHKXXRIWLGSYXTPXAAARXYDTXVFYLXGRSARLNFPDEISALAPLSPPPEELEADGGALSXASIXKKAIEVGSRVDXLQTGMTMVAXAAAPXTNXRERQRQXHXQQQAARDEELLXLHHQKQQXTXWNGRAKNPDLNQXPDPDSSDAE

The claims defining the invention are as follows:

1. A method for controlling hybridization in a plant, said method including:
   establishing or identifying a first plant strain with a first Z locus haplotype and a first S locus haplotype;
   establishing or identifying a second plant strain with a second Z locus haplotype different from the first Z locus haplotype and a second S locus haplotype different from the first S locus haplotype; and
   crossing said plant strains to produce hybrid plants;
   wherein said haplotypes are selected so that the first plant strain is heterozygous at both the S and Z loci, and said second plant strain is homozygous at one of the S and Z loci and heterozygous at the other of the S and Z loci;
   wherein said first and second plant strains are plants from the genera *Lolium* or *Festuca*; and
   wherein the first and second Z locus haplotypes are independently selected from a gene encoding a 26S proteasome subunit, or a no-pollen (NOP) polypeptide; and the said first and second S locus haplotypes are independently selected from a gene encoding a glutamate receptor or precursor thereof, or a seven-in-absentia homologue (SIAH).

2. The method according to claim 1, wherein the plants are selected from the group consisting of *Lolium perenne* (perennial ryegrass), *Lolium multiflorum* (Italian ryegrass), *Lolium boucheanum* (hybrid ryegrass), *Lolium arundinaceum* (tall fescue) and *Lolium pratense* (meadow fescue).

3. The method according to claim 1, wherein the Z locus haplotypes are selected from a gene encoded by one or more of:
- (a) the sequences shown in SEQ ID NOS: 58-59;
- (b) nucleotide sequences encoding the polypeptides shown SEQ ID NOS: 128-129;
- (c) complements of the full-length sequences recited in (a) and (b);
- (d) sequences antisense to the full-length sequences recited in (a) and (b);
- (e) functionally active fragments of the full-length sequences recited in (a), (b), (c) and
- (d) having at least 98% identity thereto and having a size of at least 100 nucleotides; and
- (f) functionally active variants of the sequences recited in (a), (b), (c), (d) and (e) having at least 98% identity thereto; and wherein the S locus haplotypes are selected from a gene encoded by one or more of:
- (a) the sequences shown in SEQ ID NOS:39-40;
- (b) nucleotide sequences encoding the polypeptides shown SEQ ID NOS:109-110;
- (c) complements of the full-length sequences recited in (a) and (b);
- (d) sequences antisense to the full-length sequences recited in (a) and (b);
- (e) functionally active fragments of the sequences recited in (a), (b), (c) and (d) having at least 98% identity thereto and having a size of at least 100 nucleotides; and
- (f) functionally active variants of the sequences recited in (a), (b), (c), (d) and (e) having at least 98% identity thereto.

* * * * *